United States Patent 9,492,524 (PLAGUE VACCINE) - sequence listing, part 2

SEQ ID NO: 19 - DNA, 4744671 bp, Yersinia pseudotuberculosis (residues 1,581,558-3,163,114 of 4,744,671)
tcggcggcggtgggggcgatggcttatgccgaactggggctgccgtggcctattgcagcattaataggtttactggttggcacatttatcggtttcttcaatggggtgtgcatcacccgattgaaaatggtctcgctgatagagacgttggcgatgatgattattatccagggcgcgctgttggcgctgacacagggcaagaccctgacaaacctttctgaaggttatatttggattggccaggcgaccatcggggggtggcccctgatgccggtggtgtttcttctggtgctggcggtgatgggggcggtgctgaagtatacggtgttaggccgttcgatctatgccgtcggtggtaatcctgttgcgtcaaactccgccgggattcgggtcgcgcgggtcaaaattattgcttacacgatttcagggttccttgccgcacttgctggctttttgttggcatcgtggcagatggccatcacctcaaaccaaggctcgagctacttgctctacgccattgccgcgcccattatcggcggcgtcagtgtttttggtgggcacggtaacgtcaagggggtgctgggcggtgtgctgctgctgacggtgatccaagttggcctcgccattgtcaatgtcccttcgttctatgtcggcatgattggcggggtgatcatttttatcgctgtcgccattgatgctttccggatccgttacttcggatagcccagcgacccgctaatccagttttctactgattaatcccatgttctgctgactaaacccatattctactgactggcccaatgctctactgactaatctaacgtgttgcttattaaacccacgggtgactcataaggatgataaaaccgtttacttagccataaatcaatcgagtggcggctggcttcaaaatgtggttcaggtaaatcacgcgggttgcaccagcgccattgctgacacttttcgggttccttcagctccggttgcccaccaaggtgttgcgccagtagacagacggagacggtatgtttgccttcctcacgccaggtcgcgaggttattacacaatgcgactacctgcacttcattgatatttaaacctgtttcttcaaaaacttcgcgtcgagctgcttgctcaaaggactctcccgcctccaaatgaccaccaggaattgaccagtagggcgcatgttgactgcaacgtttacccatcagcacttcgccttgctgattcacgataatgaccccaacgccaaccgtaacagacatggtattcactccttttgaaataacgtcagcaaccgtcagcgggtgtgatggttttactgatgacaaacgcctattcaccatgaaaatgtgcggaatgtcaaaaatccattaagaatagacgcggaaaacttgcatatattgtgaaccagaaacacaataattgaaacgtttcagcgttatcgcgtcaccagaggagaaagggtcacgcgcctttttcgcattaaagctgaaacgattcaattctagcaagagaggcgacttatgtttcagctatctacgcaagacattcatctggctgcgcaagcagacaataaaaatgcggcgatcacccaagttgcggctgcattaactcaagcgggttgtgtgactgccgcttatgttgacggcatgttggcccgtgagcaacaaacctcaacgtatctgggcaacggtatcgccattcctcatggtaccactgatacccgcgaccaggtgctgaacaccggtgtgcaggtttttcaattcccacaaggcattgagtggggcgcggaccaaactgcttatattgttatcggcatcgctgcccgttctgatgaacatttggcgctactgcgtcagttgacgcacgtactcagcgatgacgcggttgcggcacgtctggctaaaaccacttcagctgaagagttacgcagtttgctaatgggtgagcaaaaaaccgctgaattccattttgatacctcactgattgcgttggatgtggcggcagacaacctgatcacactgcaagcactgaacgcgggccgcttgcaacaaattggcgcggttgatgcccgttttgtcagtgatgtcattactcgtgagccactgaatctggggcagggtatctggttgagtgacagtaccgaaggcaacttggtcagtgcggtcaccatcagccgcccggctaccgcatttgaacacaagggtgaaaaagtggctttgctgctcaccctgtctgtggcagatgatcagccgctgaccgtgctgaactatttaagcgagttgctgctggcacaaaaagctgatgcgttgctgaacgccgatgctgccgcgttgctggcgttgttgaccagcgaatatgttgagcagagtaaagtattaagcgctgagttcgttattcgtaatgagcacgggttacatgcgcgcccagggacgatattagttaatacaatcaaacagtttaccagtgaaatcaccgtgaccaatttggacggcaccggcaaacccgcaaatggacgtagtctgatgaaagttgtggctttaggggttaaaaaagggaatcgcctgcgctttaccgccagcggcgaagatgcacaaaccgcactggataccatcggtgaagtgattgccgccggtttaggcgagggggcagcatgagcagaagagttgcgactatcacactgaaccctgcgtatgatctggtgggtttttgccctgaaatcgaacgcggtgaagtcaatctggtaaaaaccgccggtctgcatgcggcgggtaaagggatcaacgttgccaaggtgctgaaagacctgggcatcgatgtcacagtcggggggttcctcggtaaagataatcaggacggtttccaactgttattcagtgagttggggattgccaaccgttttcaggtggtaccgggccgcactcgcatcaatgttaaattgaccgagaaagatggcgaagtgacagattttaacttctccggttttgaagtgaccaaaccagattgggatcgttttgttactgattccctgagctggctggggcaattcgatatggtcgcggtcagcggcagtttgcctgcgggcgtcaatcccgatgactttactgactggatgaaacgcctgcgttctcagtgcccatgcattattttcgacagcagccgcgaagcattggttgcagggctgaaagcctcgccatggttggtgaaacccaatcgccgtgaattggaaatctgggcagggcgtccgttgcctgcattaggtgatgtcgtggaagccgctcacgcactgcgtgatcagggcattgctcatgtggtgatttctctcggtgctgaaggggcgttgtgggttaatgcctctggcgcatggttggcaaaaccgccggcctgtgacgtggtcagtacggtgggagccggtgattcaatggtagggggcttgatttatggcttgttaatgcgtgaatcgagtgagcacacgctgcgtttggccaccgccgtcgccgctttggccgtcagccagagcaatgtcggcattacggatcgcccgcaattggcagccatgatggcaaaagtagacttgaaaccttttaattaatctccggaggcgaaatgaaaacgctactaataattgacagttcgctcgggcaggccagaggccatctcgcgacactgatgctgggtgctgcggcgaaaaaagcaggattgagctgggttgagaaagccgccgacgctgaactggtgattgtcgcgggatcatccgccccggctgacagtacgttgaatggcaaaaaagtctatgtaggggacgtggaaaaagcggttcgcgatcctgacggttttctggcacaggctattgcgcaggcggcaccttatcaggccgcggccacccctgagccaacgtcagtgactggcgctaaacgttctgtcgctggtcctaaacgtattgtagccattacggcttgtccgactggtgttgcgcatacctttatggcggctgaagccatcgaaagtgaagcaaaaaaacgtggctggtgggtgaaggttgaaacccgtggttccgttggtgcaggcaatgagattacgccagaggaagtggctgccgctgatttagtgattgtggctgctgacatcgaagtggatctgaacaaatttgccggcaaaccgatgtaccgcaccacaaccggtctggcactgaagaagacggtgcaagaattggataaagcactggtcgaggctgacgtttatcagccgaaaaccagtagcagtacggcgagtaagaaaactgagaccggtggcccctatcgccatctattgacgggtgtgtcttacatgctgccaatggtggttgccggggggctgtgtatcgctctgtcctttgtctttggtattgaagcattcaaagagaaagggacgttggccgccgcattgatgcaaatcggtggtgattctgcatttgctttgatggtgccagtgttagcgggctttattgcattctccattgctgaccgtccaggtctgacgccagggttgattggcggtatgttggctgtcagcacgggggcgggcttccttggtggtatcattgccggtttcctggcgggttatgtggcgaaagccatcagcactaaattgcatttgccacaaagtatggaagcgcttaaacctattctgatcattccactggttgccagtttgatcgtcggtttaacgatgatttatatcgtcggtacaccggtggcaaaaatcatgacgggcctgacgcattggttggagtccatggggacggcgaatgcggtactgctcggggctatccttggagccatgatgtgtaccgatatgggcggcccagtgaataaagcggcctatgcctttggtgtggcgctgttgagttcttctgtttatgcaccgatggcagccattatggcggcggggatggttccaccgctggcaatgggtctggcaacactgttggcccgtaataagttcgacaaaggggagcaggaagggggtaaagctgcgctggtactggggctgtgctttatttcggaaggggctatcccatttgctgctcgtgatccgatgcgtgtcttgccgtgctgtatcgccggtggtgcattaacgggtgcgctgtctatggcgtttggtgcgcaactgatggcaccacacggtggcctgtttgtcctgctgatcccaggggctatccatccagtgctgttatatttggtggcaattgctgcaggtaccctgctcgcgggcggcttgtatgccatgctgaaacgccctgacgcgatggtggcgaaggtcgcgtaacgctcaacgtgccggcgcgtttcagatcgaatcatcggcgcttgtcagcagtctgaaatgccagtcagttaattctgactggcattttttatgggtgttataaaatcagtctcattttaatgaaatgcgaaaataaaaggcagctaatatttttttgttaaattattaagataataatcttaataagacttaatcttgtgctgggttgacttttgtttaaatattgtttagcttttgtgtataaaatttttccaattaagactcacttatggctattgagccgtcctaatattctgaattccagatcaggggaggtgagggcaaatgagtcactgtgttgttttaaataaattagaaagtgtgttaataattggtgacagtagatatgctttatccaagaatgaggtgctgctgttagagtgtctttatttacgtgccggtgatgtgatctcccatgatgaattactgacaacctgttggcctgatcgagtcgtctccccaacatcactgccggttgctattaaacatatccgtgatgtattccgtaaaataacccggagtgaggtgataaagacatataagaatgagggctatagctatcaaaaggatagtgtactaattattattgatgatggcagcaccgaaaaagagagtcatagcgcagcatataccagaaaggaaaaacccgacataccaataaaattggttggattacaaatactttctcacctgaactcaaccttttttatcgctattatgatggtcatcatcatcatatttttcatggtaggaggtaatgatattgtctcatttattgatagtgataccaacagtgtcattataacgaatgtgacaaccaagatgaatggcccaacggcaggcttaccgaaggtgaagaatagtatgatatttaaggatgattttggtttagtcattatctgtgatcaatcggaatgcaaacagcaatgaaagcaaaatcacttactctcatatctataacagtaatgtttttcttatttttaatctatagctttaatgacttatttttttattctgaagtgaaatatggcgatatccatgagcatcttgatttaagaatgcaagggataagatttagcctctcacattatattattgatgataagtctcaactggtgatttcagagggaatatatggtattggtttgaaaatgccaacggggaagtattacctattccctcttcattcatatcagtcatcccctgataatatggccagaggatcgctgaattcattggcctcaccgttgtctttgtatgtctatgaaatacataataaaaaaaataacgttgtcaccttttttaatggtgacagaggctttattgatgtcaatggagaaacgatccacttatcttctctgtttctcggggtacaaggagaacatatccatacgtcctatcatgacgttagttaatcattttatctattgattttctattttagatgacatttttaaataataaatatggcgtctgtctatattggtatctttagaaccgttttttactccttaggtactatgctcatcattattaatgctctttcatacagataataatcaactaaagcatgagagttaatgtcatgatagataatgaaataaaagcgtcaaatagcattgggttgttttccaagattaatcttaacattattatttaaaatttaatcattaataattttaaacatccagaagtgggttatatgatgacgctgttagtggtgatcgggagttgcaaaaaataaagttgcagaaaacacaaccacaacaggaacgaaactggaaactggtgtttcggggaaaataggatttattttctctatctataggtctgcgactgagttattaatataaatatattgatttacaatgtagttatatttaattgcccaatatcaccactagcatattctacgctatgtcgtaatagcaattattacatttaatggagactgttctcatgaaaatgaaatgttttgcgaaaaatgcgctggcggttaccacactaatgatcgctgcttgtggtatggcaaacgcttctactgtcattaactccaaggatgtttctggtgaggtgactgtcaagcagggaaacacattccacgtcgattttgcgcctaacacaggagagatttttgcgggtaaacagccgggtgatgtcactatgtttacgctaactatgggtgatactgcaccacacggtggttggcgtttgattccaacaggggactcaaaaggtggatatatgatcagcgccgatggtgactatgttggtttatacagttatatgatgtcatgggtaggtatagataataactggtatataaatgatgactctcctaaagatataaaagatcatctgtacgttaaggcagggactgtccttaaaccaacgacttataaattcacggggcgtgttgaagagtatgtattttaaataacgagtaatcatagaacatgatggcttgctgtcatgttctatgtatgtttttgttattgatgttttattgtgagtttttttaaaattcacaataaaatatcatgataatgtgagtgattgaaaatgaagaatctatttttttctgcatataaaaaagtattttcttatatcacatcaatagtcatattcatggtgtctttaccttatgcttattctcaagatgttgttgtcaatacgactaagcatctttttactgtaaaaatagggacgacgcgggtcatttacccttcgtcttcgacaaaaggggtatccgtatcggtggctaatccacaggattatccaatattggtacaaacccaagttaaagatgaagataagacgtcgcccgctccttttattgttacccctcctttattcaggcttgatgctgggttacaaggccgtgtacgtattattcggaccggtggaaaattccctgaagatcgtgaaacactgcaatggttgtgcctaacggggatcccacctaagaacggtgatgcttggggtaatacgcaaaataatccaaaaaattcatccccaactatggatattcaaatgtctatcagtacctgcataaaattattattcagacccgataaagttaaaggagatccgacggatagtgcggattcattaacttggagatataaaggtaactacttggaagttaataatccaacgccattctacatgaatttttattcactccgtattggtgatgaaaaaataaatttatctgatttaggttcaaaggatgaaataaaaaatggcagctatgttccgccattctcttctagggattttattattccggtaaaaaataaaggtaaggcaacagaggttttttggcaagtgattaatgataatggtggtgtgagccgggaatttaaaagcacagtccagtaagtttctatttatatttttcagaaaatacctggggtattattttgaaaaaattaatagttcaatttactactattactctattgatgagcacttcatttttagtgggtgcccagcgttattcttttgatcccaatctgctagtggatggcaataacaacactgatacctcgttatttgaacagggcaatgaattaccgggcacctatttggtggatattatcttgaatgggaataaagtggactctacgaatgtgacatttcattcggagaaatcgccatcaggagagcctttcttgcaatcttgcttaaccaaggagcagctatcccgctatggtgtggatgttgatgcctatcccgagttatctccagcattaaaaaactcacagacaaacccgtgtgtcaatttagccgctatccctcaggccagtgaagagttccaattttataatatgcagttggtactgagtattccacaagcggctttacggcctgaaggtgaagtgccaatagaacgctgggatgatggtattacggcttttttgctgaactacatggcaaatatcagtgaaacccagtttcgtcaaaatggtggataccggcgttcacaatatatccagttatatcccggtttaaatttgggggcgtggcgtgttcgtaatgcgaccaactggagtcaatctggcgataggggggggaaatggcaaagtgcttatacctatgccactcgtgggatttatcgtttaaagagtcgggtgaccttaggggagagttacaccccaggtgattttttcgacagcattccctttcgtggcgtgatgttgggggacgatcctaatatgcagccaagtaaccagcgggattttataccggtggtgcgtggtattgcccgtagtcaggcgcaggtggaaatcagacaaaatggttatctgatttatagtacggtggtgccgccggggccgtttgaactctctgacgtgatcccgagtaaatcaggcagtgacctacatgttagggtgctggaaagtaacggggcatcgcaggcgtttattgtgccttatgaggtgccagccattgcattgcgcaaagggcatttgcgatacaatctggtggcagggcagtatcgccccgccaatgctgatgttgagacgcctccggtcgctcaggcaaccgtcgcctacggcttgccgtggaacttgaccgcatttatcggtgagcagtggtcgcggcattatcaggcaacctctgccggattaggggggctattgggggagtatggcgcattgtcatccagtatcacgcaggcaaccagtcagtatcaccatcaacaaccggttaaagggcaagcctgggaggttcgatacaacaaaaccttacaagcctctgatacgtcattttcattggtgaatagtcaatacagcactaatggtttcagtacgttatctgatgtattacaaagttaccggcagagcgggagtggcgataatagagataaaattgacgaaaattctcggtcaagggatttgcgtaaccaaatcagtgcggtcatcgggcagtcattgggcaagtttggctacctgaaccttaattggtcgcggcaggtctaccgtgggccgattccggctaagaattcattgggaatacactataacctcaatgtcggtaatagtttttgggcactgagttgggtgcaaaatgcgaatgagaacaagaatgatcgaatattgagtttgtctgtcagtattccgctgggaggtcatcacgatacttatgcttcctatagaatgacatcttccaacgggagcaatgatcatgagataggaatgtacggccaggcttttgactctcgcttgagttggagtgtgcgtcaggcagagcattatggtcaacccaactcagggcataacagcggctcactcaggttgggctggcagggttcctatggcaatatcgcgggaaattactactatactccgagcatacgtcagttatccgctgatgtttccggaggggcgatcatccatcggcatgggctgacattagggccgcaaatcaatggcacctccgtgctggttgaagttccgggcgtcggcggggtgaccaccacagaagatcgccgtctgaaaacagattttcgcggttacagcattgtgtctggcctctctccttatcaggagcacgatatcgtgttggaaactgcagatttaccgccggatgcggaggtggcaaaaacagataccaaggtcttgccgaccgagggggcgattgttcgtgccagttttagcccgcaaatcggggcaaaggcgctgatgacgatcacccgcgctaatggccaaaccattccgtttggtgcgatggcgagcttggttaatcagtcggccaatgcagccattgtcgatgaaggggggaaagcctatctaaccgggttaccggaaacagggcagttattggtgcaatggggtaaagatgcgggccaacaatgccgggtggattaccagctctcgccagcggaaaaaggtgataccgggctgtatatgctcagcggagtatgccattaaaggcatccgcgatgacacaattcccgttaggttcaattcccgtcaggttcaattcccgccaggtttactggcgggcattttctacgttacaacgagggctcaatctctgcctgtgatttcagccaggcgatctcttcggcccagatatccatattcaccgtttccagaatcaatgggatattatcgaaacgtgagtcgcgcataatatagctgaatacggttttgccaatattgccttcacccaggctgtggtggcggtcaacccggctgttaaattcgcttttcgcatcattaagatgcatcccacgcagatactggaagccgacgatcttgcccaatgccgcgaaggtgtgctcacaatcttcttcagtccgtaaatcatagccagcggcgaaagcatggcaggtatcaatacagacgccgacgcggcttttatcttccactctttcaatgatggcggctaaatgttcaaacttaaagcccaggttactgccctggcctgcggtattttcaattactgcagtcacgccttcagtggcgtctaacgcgatgttgatcgattcggcaatccgcgccaagcattggtcttcatcaatttgcagtaaatggctaccgggatggaagttcagtaatgataaccccagttgctggcagcgaactaactcatcgataaaggcttcacgggatttttccagtgcctcggtgactgggtgcccgagattaatcaggtaactatcgtgaggcagaatttgtgccgaggtatagccgtacttctcacacgcgagtttaaatttctcaattacgtcttccgctaaaggggcggcccgccattgacgttgattcttggtaaacagcgcaaaggccgtggcctcaagttcatgcgctctaattaccgcttgatctacaccacccgctgcgctgacatgtgcaccgacaaatttcattccattctcctttgataaccgggccattatggcattgatagggacatgattgaatgggataagcggtgaagggaaataagggccgcggatacggcccttaaacggtttgttttagcctgtgaggtttttgcaccagtaagatgcttcacacaagtgagatgatttacacaagtgcaatatgttgcacaaataagttgataccggtgccaccgaccaataaccagatgaacagcaatagggccagtaacagtggtttcaccccggcttgacggatggaaccaatgtgcgtggttaatcccagcgctgccattgccatggccaacagaatggtatccagcgtaatcagatgattaacccagaccgcaggcaacagattcagtgagttaaaacccgccatcagaatgaagatcaccgcaaaccacgggatggtgatagcgcttttctcgcgtttttcaccgcttgtttttatgcggctacggcccagataggcggaaagtagcagcaggaacggtgccagcatcatcacgcggatcatcttggtgatcaccgccgcattttcagcatcagggccaatggcatgtccggcagcgacgacctgagccacttcatgaatggtcgaaccggcaaaaataccaaatgtctcctggctgaaaggcaaccattgataatgcaggtttagctgatacaaccaagggtaaacaaaaatagccagcgtaccgaaaatgaccacggtggcaacagcaaccgccactttactggcatccgctttcaatacgggttcagtcgccataatggcggcggcaccacagatgctactaccggccccgatcaacatcactgtttgctgatccagaccaaatacccgcttgcccaaccaacatgccaatataaaggtggaacttagggtcaataaatcgatcaccataccggtcgccccgacatcagccacttgctgaaaggtcaggcggaaaccgtacaaaatgatccctagccgcagtaaatactgtttggcatagaccacaccatctgaacagaccggctgtagccatgggtacagcgtatttcccacgataatgccgaagagaatagccagggtcagcgcccccagccccatattgataaaccacggcatatcgcccacattaagggctaaacccgtaatcacacccgttaacaccaaacccggaatatagcgggtcatcacagtaaacagctgagggcgggggagttcttttgtctgagaagtcgccatgtgacctcctgtttgcaatgaatatgggcatagtttaacgatattgtcttaatagataaattcattatatatttatatcttatcgatataagtggtaatgttgcgtgcaggcttatattttgagcggtgtcagatatcagcgaattcagtaagcgataggcgagggagcatcactaatgacagtggaatggggatttttgctatgaaaaaaaccagccatgaaatagccgttgtgggtgatatgaaactgtaaataagtctgtgtaaccgcagcccttatttatttttcgcacttctacttatttgctcgcttatttcttcaaattatataatttaaattctgtctatatggttcctttgcaacaggttaatccctttaaaatagagtaaggcattccatcctggtaagtatttggctattttctaattatatgattatttttcatgtggttatatttatttttgtgaccactttttatcgttttcttttgctggaaaatgataatgaatcgcattgaatggcctgattttctctacccatctcccgtttttacttaaaagtgttagtcttatacggtcattgaggcgatataatcacttcgtcaataaccgcgtccccttttattattgttcctctttattactacagagaacgttatgcatataaccttgcgtcaacttgaagtctttactgaggtactaaaaagtggctcaacgacccaagcctccgtggtgcttgcgctttcacaatcagccgttagcgcagcattggcggatttggaagggcaacttggggtgcagctttttgaccgcgtgggtaagcggttagtcacaaatgagcatgggcgattgctttatcccaaagcgttggcattactcgatcaggccatcgaaatcgaacagctgtttttgcatgatttgggcgcattacgcatcgcggccagcagtacgattggtaattacatgctaccggggatgattgccaaatatcgccgtgacttccccggaacacctttagagctgaatatcggtaatagccaggatgtgatcgaagctgtcgccgactttcgcggtgaccttggcctgattgaagggccgtgtcatatgccagaattggtcacgcaaaattggctacgggacgagctagtggtgtttgccgcccctgatagccccttgtgccataaggcgctaacgttagtcgaccttgctgatgccgactggattttacgtgagcgtggctcaggaacgcgtgaagttctcgatcatttactcttggcacagttaccccacttcaagttagtgatggagttgggtaactccgaggcaataaagcgcgctgttcgctacgggatgggggtcagttgcctttcgcggcgagtgattgctgatcaactcgccagcggtgagttggtcgagcttaatattcctttaccgcccttaattcgcaccttgtatctgatccaccatcggcaaaaacatatctccaacgctttgctgcgctttcttagttattgtcaggaagaagagtaaaatgcgccactgcagcagtgtgtgcgacgtgttttatgctgatgacaggctttatcgcggtaaagtgttttataccagtagggtgagttttttcggtcagaatacccaccctatatccgcttttatttatcatttaggcttttactaataatttagccgggattatgaaggtatcttatatccgtgcattctggctatccgagccggtgagatttgttacaatcccgccttatttttaagggtggattagggtaagaatgactcagcaaaatactaaaatcccagcgcagcagggtgcacagcgcttacgccgggagcttaaatcgcggcatttagccatgattgctatcggtggttctattggtaccggtttatttgttgcctctggtgcaacggtatcgcaagccggtccagggggggcattgctctcctacgcattgattggcttgatggtttacttcctgatgaccagcttgggagaattggctgcgttcatgccagtttcaggctcattctctacttatggttctaaatatgtcgaggaaggctttggctttgccctaggttggaactactggtacaactgggcggtaaccatcgcagttgacttggtagccgcacagttagtgatgaactactggttcccggacgcgcccggttggatctggagtgctttattcctgggcctgatgttcttactgaactacatctcagtgaaaggtttcggtgaagcggaatattggttctcgctgattaaagtgacaaccgtggttatcttcatcatcgttggtgtcatgatgatcaccggtatcatgaaagggggcgaaacggcgggttggcataactggactatcggtgatgcaccatttgctggtggtttctctgccatgattggggtggccatgatcgtcggcttctctttccaggggactgaattgattggtattgcggctggggaatccaaagatccaggcaaaaatattccaaaggcaattcgcaaagtgttctggcgtattctgttgttctatatcttcgctattctgattattagcctgattattccttataccgatcccagtttgttacgcaacgatgtgaaagatatcagcgtcagcccgttcacactggtattccagaatgcgggtctgttatcagcagcggcagtgatgaatgcggttattttgaccgctgttttatcggcgggtaactcggggatgtatgcctcgacccgtatgctgtttaccttagcctctgaaggcaaagcaccgcgtattttcgccaagttatctaagggcggtgtccctcgtaatgcgctgtatgccacgacagtcgttgcaggtttgtgcttcctgagctccatgtttggtaaccaaactgtgtatttgtggttactgaatacctcggggatgactgggtttatcgcctggttgggtattgccatcagccactaccgcttccgtcggggctatatgatgcagggccgtgacttgaacgacttaccgtatcagtctggtttcttccctctggggccaatttttgccttcgtcctgtgtctaatcatcacgttaggccagaattatcaggcattcctgcaagaccgtattgattggtatggcgtgacggcaacctatattggtattccattgttcctggtgatttggtttggctataagctcagccgtggtacccgggtagtgaaataccaagagatggaattcccaaaatggcgtgatgagagtgaagagcatcagaaaccgacaagtcggtgatgtgcttggctctataacgtgcggatgaaagggcgataacgctatcgcccttctttagtgcctataaattagcggtaactgacgccaataccagtacgaaatgtgctggtattagcgcattctatccgtgaacatcaggctaaattagccaaactgatccaataatattaccaggccaacacttacaaaaagttacgtccaattacttatggcaatcttattgataagtattatcatttgctttattgttagcgccatcttatgggaacaggtaaggggtttggcgtgaaatgtgtttcactgaaaatggctaaagggttaactatcagtttgttattcggctgggccttgatggctggctctagtgccttggcggcaacagtgactgacatggctggccgtacggtcaccataccggctaaagttgagcgtattttactgggtgaagggcgcttgttctatgctgtctctttattggaaggtaataaaccgttagaccgtattgttggctggcagggcgattttcgcaaactggatccccaaacttacgccatctataaagcaaaattcccgcaaattgatcaaatcccccttattggtaacacgaccgctgacagtatcagcccggaaaaggtgctcaccttaaatccggatatcgctatttttggtttatctggccatggtccaggtaaaggcagtgaattagtcaagcaactagagaaagccggtgtaccggtcgttttcgtggatttccgtaattcgccattaaagaacacgttgccaagtatgcgcttgctgggcaaagccctgcaccgcgagcagcaagctgaaaactacattaatttttatcaagataatgtggacaaggtgaccgatatcaccaataaaatcccggaagataaaaaaccgagcgtatttattgaattacgtgcaggggcgtcggaagagtgctgtggtactgccgggaagggcaatatgggcgactttatcgatcaggcgggcggcaataatattgctaaaaatctgctgcctggctcgctaggtacggtgaatttagaaaaagtattggcggcgaaaccagatatctacattgccagcgggggcaaatcaccaggcagcgatgcaccgggtgtcgtccttggtgcgcaggtaacgcccgagcaggcacaggcctcgttgcaaaaaattctgggccgtaagggaatcaataccctaagtgcggtcaacacgggtcatagctatgcgatttggcacaattactacaattcaccgtataacgtattggcaattcaaagctttgccaaatggttctatccagagcaatttgctgatctcgatccgaaaaaaaccatggacagcctgtattcacagtttctggctgtcgagccaagtggcacctattggattgaagcaaaaagagagttggattgaagcaaaaatagttggattgaagtaaaaatagttggattgaagtaaaaatagttggattgaagccaaaaaatagccggcgcgaagtggccgagtgaatgtgaagtaacctaatccgtactaaatataagctgtatcaaatagagcccgtaacagattggtctatagcagatgccgcccagagtaggtagatagaagcaaatgagtgtaactactgaacccatgacaaaaacacataacccgcctgatctcagtgttatggggcgttatcagaacattgtacgccaccgcttattagttatgggtgtgctggtgctcgccatcttgggctgtttgctgttggatttcaccatggggccttctggtttaacgttgtcatcgctgtggcagacgttgattgatccagccagtgccgatgccggtacccgagtcatcgtctgggatattcgcttaccgtatgctttgatggcggtggtgattggcctgtctctcggtcttgccggggcagaaatgcaaaccattttaaataatccactcgccagcccgtttacgttgggagtgtcttccgccgccgcattcggtgccgcgttggcgattgtctcggggattggtataccgggtgtccctgaccagtggtttatttcggttaacgcttttatttttgcgctattcgccgcgctgatgcttgatggcatcacccgctggacgcgagttgcaagctcgggtgtggtgttgtttggtattgccttggtctttaccttcaatgcgctggtatcaatgatgcagttcattgccagtgaagacacgctacaaggcctggtgttctggactatgggcagtctggcacgagcatcttgggccaaactgggtattatgctggcggtgtttgcattgatgttaccgctgtcgatgatgaattcatggaagctgacagccctacgtttaggcgaagatcgcgccattagctttggtattgatgtgcgccgtttacgcctggggacattattgcgcatcagtatgctatcagcactggcggtggcctttgtcggcccgattggtttcatcgggttagtcgcaccgcatatcgcacgcatgatttttggtgaagatcaccgtttttacttaccagccagtgccctgattggtgcattggtgctgtctatggcctctatcgcatcgaaaaatctgatccctggcattattattccggttgggatcgtcacctcgctggtaggggtgccattcttcctgagtattattctgcgccatagggggaatgtatgactgcgggtctacgtattgagcgtttttatgcgggctatcccaaacggccagtgatccaaaacctgaatgtccccttgctccctcgcggcaaaattaccgtattactggggccgaatggcagtggtaaatcaaccttattgcgctcactggcaggtttgaaccgcgcagaaggccagttgtggttagacggcagcgacctgatgaaaatgccgtttacccagcgggcagaaaaagtggtctatttgccacaatctttgccggcgggtgtgcatttacatgtgctggaatcgattatcgtggcacagcgagcctccggtggccgcagtaatactcgcagtgaggcccaagtcatggcgttgttggaacggctgggaattgcccatttagcgctgagttatctggatcaactctctggcgggcagaagcaactggtgggtttggcacaatcactgattcgccagccgtcactgttattgttggatgaacccctcagcgccttagaccttaactatcagttccatgtgatggacttggtacgtcaggaaactcgtcaacggaatattgttacggtggtggtggtacatgacattaatattgccttgcgccatggtgatcatgtcctgatgctacaaaatggtgctttgatcgccgatggtcagccagaagaggtgattacaccgcaaagcttggccaaggtctatggcgtgaaagggcgtattgagcgttgttcacaagggacaccacaagtattaattgatggattggtaacagaaccgacaatgtaactcatttaatcccctgcgttgttgaatttgtaagcgtgttagctgccatgacaatgacgtagggtatatttcagctgtaactggttttataaaaagaataatcaagtggaaaaagtgaaaactttatttctgcttatgtgagctattgtcgaaaattatacaaatgatatttctcacctgcccgtcaggcggtgttttcgcgagaaaaataacctgatgaaaaggagtgaattaatttacacctcatggggattatagagtggctaaggttaaccaacgttttagaaaaacacattcagcggcattagttatagcggcggttatttcatcgcaagggtatgcggctgaaaaaacaaatacagccacaccaaccgatacaatggtggtcactgcgtcaggtttccagcagcgtattcaggattctgcggcctcaatttccgtggtcacccgcgagcagattgaaaataaagcttatcgtgatgtcacggatgcgttgaaagatgttcccggtgttgtgattaccggagggggcagtacaagcgatatcagcattcgtggtatggcggcgaaatacaccctgattctggtcaatggcaaacgtgttgatacccgcagtaccaggccaaacagcgatggctctgggattgaacaaggttggttgccccctctggcggccattgatcgtattgaggtggtccgtgggccaatgtcctctttatatggttcggacgccatgggcggtgtgattaacatcattacccgcaaagtgggtaaagagtggcatggcacggtacgtgcggatgcgaccttacaggaggacagcaagtccggggatatattccagaccaatgcttacgcctcaggtcctttaattgacggtttattgggccttaaagtcagcggtctactttctcatcgtagtgaagataaaattatcgatggttataatcaacagcgcatgagaaatggtacggcaacatttactctgacgcctgacgataataatgaatttgattttgacattggccattatgtacaagatagaaattcaaccccaggacgaacactggcattaaacggaacgaatagtgacacccaatatgaccgtaataattatgcggttactcataatggttattatgattttggtaattcaaccagttatattcagcgtgatgaaacccgtaatccatcccgtcaaatgaaaagtgtggataatatcttcaatacccaaacatccttcttattagataaccacactttaattctgggggggcaataccgttatgaagaactgtatgataaaggtaaccaattaccttctgccagtgatctgaagaaattaacccgttggagctgggcattatttgctgaagatgaatggcagatgaccaacgatttcgcgctaactggcggcattcgtatggatcaagatcaaaactacggtacccattggacgccacgtttatacggagtctggcatttagcggaccaatggacattaaaaggcggggtatccggcggttaccgttcacctgatttacgtcaggcaaccgatgactggggccagctctctggtgggggaaaaggcgggcttcccgcacttattctgggtaattctaacttgaaacccgagcgcagcattagccaggaaattggcatactgtgggacgatcaggaagggatgaacgccagcgtgacgctgttctataccgacttcaaagataaaattactgaagtacgcaactgtgatatcaccacaaatacgactgggcagtgtgtatttaatggtatcaattataaattcatcagtgatcgtattaacgttgataaagccatgactcgtggggcagaagcgacctttgcttgggatatcaatcaagcctggtcgttagccactaactatacctttacccaatctgagcagaagagcggggcatttgccggccagccattaaaccagatgcctaagcatatgctgaatgggacgttaaactggaaaactaccgaagattttgcaacctggatccgagccaattaccgtggcaaggcttctgaatatcttaatcgtaccagtatgggcagccgtactccgtcatatacttttgtcgatttaggggcaaattatcagctgacaaaagaagtgcgtctgatgggcggtgtttacaacctgttggataagcgtgtggatattgacgttaacgataaggtgttggatggtcgtcggtatatggtgggtgccagctacgatttttaaccgcctctccccttcgtccttgaagttgcaggggtgttagctgcgcgcacttacccgaatcacttacttgagtaagctcatcgggatgcgtttgcttgctgcctacctgcaactccaatgactttggggagatctttcgtccttgaggctgcaggggggttagctgagcgcacttacccgaatcacttactggctgttgactttaaaataagtaagtgattcgggattttgatcagcaatgccaaggtgttttggaataaaagaagagtattaactcaaaccaatagcaatcactttttggaaggctattctttgcgtcaggctctgataccagcgctgtaaatgcggtaattccgggcgctcgatcggtaagttaaaccaggcataggccaggcagcccagcggaatatcaccaatgccaaaggcatcgccggaaagataggcttgttcccccaacgcgtcattggcaatggacatcaacgtattcattttctccattccctgagcaattttcactttatcctgctgttctggtggggtgcgcaccaaaccgataaacacagctttaaagggctctactacactggatgtcgcccaatccatccatttttctgcactggcccgctggtggtgatcggccagataaagtgaattttgaccatattgtgcggctagataacgcacaatggtgttggattcccacaggatgaaatccttatcttgcaggcaggggatcaaaccatttggatttaacgcgcggtactgtgggtcattgagtttgccatattgccccccgatatcaatgcgctgataggggattcccagttcttccaagcaccacagcacttttttgacattggtcgagttatttcggccccagactgtcagcatgcaaccccctatatcgtgacaaaaaaatatggcgacaaagagaaaacagcacaaatttccatgcccggtcaccgatatcgataaccgtgcgagtaaaatcatgggccttctattatgtcagttctatctgttctatctgttctatctgttctatctgttctatctgttctatctgttctatctgttctatctgttctatcagttctatccgtgatgttgccaatgatggatatcccactggtgtaaaaccgctaaatcaattaattcagcccctggattaatcaccgctgcgtgatccacatattccagcaggggttggtcattaatcgagtcgctgtagccatagctacgtttaaagtttagctggggtgaggccgatagccactggttcagccgatcaacctttcctttctgataggtcagggtgccataggtctggccggtatagcgatcattttccaccgtaacaccgattgataacgccgtatcggcggcaaagtgtttcgcgattggagtgaccaaatgctcacctgacgctgaaataatcacaatatagtcgccacggtcgcggtgccaggccagtttttccaaggcttgtgggtaaatacgcggcagaatatcgtgcgcgataaaatgttcaacccagccggcaacttcagcggtgtgtttgcccactaacggtgacaatgtcgctgccatataacccgccatagacaattgcccctgataatactgcgtcattaaagtctgttcctgttctgacagctcaaagggagcaagcccttcattcaccagccaacgtatccatagaccagtactgtcatcgctgattaatgtttcatctaaatcaaacagggccaaatccattaaaccacctcctaaataagccgaaaaattgaacggaaacttaaccgtgtctgtgctgaacacccgatgttttttcccagaataacgcggggcaaccgctagccggctccgttctacccaacgggaggttagctgttgattaagacagcatcatgatccccctttgtacttgaaatcgcagggggttagcgcgcgcgttactcatcccatcaatcatgaaagaaataacatagaacggaatgatattggagggttgttaattttgggtgttaattatttatatcgaatagatatagattgttagatatctggtcgaaaattatcttaaaaaacagagattgcccacaacgctaagcgtgttgccgtctgttggctttccccccatggctcaggagctgattatgctgattattcgtttgtatggttgtcccgttttcattggtttcgaaccccaaaaaccaccaattgaaacgactggagtgaaaaatgggccaacaggtattaagtcatcaatcagtcagtagccaatggctggcgaatcagtcagcgaccagcacattaccgctactggatctttcactactcagtggcagtgataccgaacgccaggcatttttaacggccttgcgccatgcggcgcgggatgtcggttttttttatctgaccgggcacggtattgatacctcgttactacggcagatacaaatcctatcacggcagttctttgcgctgagcgatgaagaaaaactgtcaatcgccatgattcgctccccgcattttcgcggctataaccgtgctgcttcggaattcacccgtggtcagccagattggcgcgagcaattcgacattggtgctgaaagaaccccattaccacaaatcgcaggcgcacccagttggacacggctgcaaggcccgaaccaatggccaaccgcactgccagaattaaaacctgtgttattgcagtggcaagaggagatgacccgcatgtcactgcgcctcctgcgggcattcgcactggcattggatctggatgagcaggcttttgatgcgttgtacggtgataaacccaatgaacatatcaagctgattcgttatccagggcgggaggcgacccaaagtgggcagggggttggtgcgcacaaagattcgggtttccttagcttcttactgcaagacacgcaacgcggtttacaagtcgaagtggaagagggccaatggattgatgccgtaccgcgtgaaggcacttttgtggtgaatatcggtgagttgttggaactggccagtaatggttacttgcgtgccaccgtacaccgggtggaaaccccacccgccgggattgaccgcctgtctattgccttctttttaggtgcgcgtttggatgcggtggtgccactgtatccattatctgccgcattggcggcggaagctcgcgggccagccagtgatccgcacaacccgttgttccgtgatgttgggctgaattatctcaaggggcgtttgcggtcacatcccgatgtggcggagcggtattactccgatgccctttgttcttgaagtggtaggagtgttagctgcacgcacttacccgaatcactgacgtgagtcaactcatcgggattcgtttgctggctgcctacctaccactccaataactttgggcatgcccttggtccttgaagtggtaggggtgttagctgcgcgcacttacccgaatcactgatgtgaagcggtaacactaatgacaattatagagttagcatcttattttaggggcaatcacgatgactaaaacacctgtttctagcctggttcgtacagcattattcgcagcattagcttctgctttcagcttatcagcccaggcggctgaggcactgcgggtagcggctgaccccgtgccccatgctgaaatcctgcaattcgtacaaaagctggacccttcactgaatttgaccattatcgaaatccccaacggggtgaactccaacgaattgctggcccatggcgatgttgatgctaattattttcagcatctcccatatttacactcacaagagcaggcactagggcaaaaatttgtggttgcagccaccgtccatattgagccacttggcatttattcacacaaatataaaaacgttgccgaagtgccggataagggcagcgtcgcggtaccgaataacgtcactaacctcagccgtgcactctatttactgcaagagcagggactgatcaccttaaaaccgggttttactgacccagccaaacagcaggcaacaccgaaagatatcgcggagaatcccaagcacctgaaaatcttggaaatcgaatcaccacaaatccctcgctcattggatgatgttgatttagccgtcattaatggcaactatgctctggaggcagggttaaatccggcaaccgatgcattggggttggagaaagctgaaggtaatccttacgccaatattttggtgaccacccctacgttggaaaatgatccgcgaatcaagcaactggcaaaagatttgcaatcgcaggaagtggctaaatttattactgaaaaatatgctggctcggttatcccggtggcaggaactcaaccatgattagcatcgaacggctgagtaaaacctatccacagggggggctgccgatggtggccttggaagaggtctcgcttgagatcccaaccggctcggtattcggtattgttggccgcagcggcgcggggaaaagtaccttgatccgctgtttgaatttgctggaacggcccacctcgggccgaattcaagtggacgggcgcgagttaaccacgttgtctgatcgcgaattacgcctgcaacggcagaatattggcatgatcttccagaatttccacttactgcactcgcgtaacgtttgggacaacattgcggtggggttggaaattattggtatgcctaaggcgcaacgtcaacagcgcgtcgcagaattgttggatttagtgggtttaagtgacaaagcctacgcttttccctcgcaattatccggtgggcaaaagcagcgggtggggatcgccagagcattggcggctaagccgtcatatctgttatcagatgaagcgaccagcgcgttggatccagaaacaacggcctcgatattggctctgcttagcgatattaaccgccaactggggttaaccattgtgctgattacccacgagttggatgtggtgaaatccatttgtgataacgccgctttactggagactgggcgggtggttgaaaccggggctattgctgatttattgtccgatccgctttctcgcttggggcgttcattattgccgacctgtggcccgctctccgtatctgccacgccgagagcagaattgacgttctttgacacgttggcggcctcacccgtgctcagtgcgttggcacaacaacatgcggtgggggtgacattattaggcggcggcgtggagtttatcggtggtcagcgggttgggcgcttgcacgttgatttcaaccgtccagagggcgggttgaatttagccgaagtgttacagtttttgaatgatcgcggtgtgagggccgagctgatatgaaaaatggcatgagttggcaggaattactggtattagtcgctaatgccagcggagaaacgatttatatggtgatgatcgcgacctttttcaccgtattgattggtttgccattgggggttttactgtttgtctcgcgacccgcaggagtgctaccagcaccacggctgaataccttgattggtgcactggtcaatgtggggcgttcaatgccttttgtggtgttactcatcgccttaatccccatcacccgctggattatcggtaccacactgggcagtactgcggccattgtccctatcacgttaggggcgatccccttctttgcgcgggtcgttgaggcggcattggacgaagtcgataaagggcgcgtagaagctattttatccatgggtggctctgcccgccatgtcatccaaaaagtgttgttgccagaggcgctgcctgcattattggcaggtataacattaacggtagtgatgctggtgggattctcatccatggctggcgtgatcggtggtggtgggttgggcgatttagccattcgctacggctatcagcgctttaataatgaagtgatggtcgcaacattagtgatactggtgattttagttcaagggatacaaagccttggcgataggtgggttaggtcactggcacaccgccgctgataccattcacgctatatttttcactctttgccctatattctccgttcgttatctcatacctctctttagtgcttagattgccgggcgcttagccaaggagagagaaagccgcatcatcatcaaaatcgctttaaatcaggatctttacaaaacaaaacgtaaaactatacccaattacaccgataatgggataaatttagaaaagacactgaagtatggctaagctaacactttagtctcagtggaaagacgttatttttcgctaattggacagtggcgatctctgggaataccactaatttccgattatttgcaaggatactctggcgacctcatgatgaaatatatcctccctttcaagattaaaaattttacgttcagtgcaggtttattgcttctggcactgcctgctgcttatgcagtcgatgaccctgccgctccccagattgatgctaaagcttatgtgctgatggattttaatagcggaaaagtgctggcagaaggcaatcctgatctgcgccttgatccggccagtttgacaaaaatcatgtccagctatgtgatcgggcagtcgattaaagcgggcaaaatacagcctgatgatctggtcaccgtggggaaagacgcctgggcgaccggtaacccagctctgcgcggctcgtcgctgatgtttttgaagccgggcgatcgggtaaaagtgtctgatctcaacaaaggcattgtgatccaatcaggtaatgatgccagtattgcattggctgattatgtcgcgggtagtcaggacagttttgttggcctgatgaataactacgctaaagcacttggcctgagtaatactcactttatgacggtacacggcctggattcaccggggcagtacagtactgcgcgtgatatggctttactggggcaggcattgatccgcgatgtgccagaagaatatgcgctgcataaagagaaagaatttacctttaataaaattcgccaaaccaaccgtaaccggctgttatggaacagtagtttaaacgttgatgggatgaaaaccggttataccaacggggcggggtataatttggtcgcatcggcgacagatgggccgatgcgtttgatttccgtggtgctgggtgcaccaagtgacaaagtacgctttagtgaaagtgaaaaattgctgacttggggtttccgcttctatgaaaccgtggtgccaattaaatcaacaaagccatttgtgacagagaaagtgtggcttggcgataacagccaggttgaacttggggtggcggaggatgcggcgatcaccattcctaaagggcagatgaaaaatctgaaagccagttataccctgaaccaaaccgagctacgcgcgccgctagcgaaacatcaagtggttggaaccatcgattttcaactcaatggcaaaaccattgaacagcgcccactcgtggtgttgaatgaggtcaaagaggggggcatctttagccgtttctgggattacgtaatgatgaaacttaaccaatggtttggtgggatattcggctaatttagccagtattagccagcagaaacccgtattagtccgtagaaatcaatagtccgtagaaatcaatagtccgtagaaatcaatagaccgtagaaaccaatagaccgtagaaactaagagtccttaaaaacccataagtccttaaaaatccataacataaatagaaagcgcgatgtgactatcgcgcttttcaggatgtttctcaggggataagctacaggcaacgacctttatcacccgatttccacgaaaatgttccactgtatctttgctatctcttttccggctttctatatcacttcaatgtttttatccaaacaaacacatggctcactggtcagatgcagtgccgaatgggtcagtgcacgccatttaccgcaatatcaatgaaaaaaagaagaaaaataacaggctggccgtggaagtggccagcctggagcggttaatcaaacgatcagttaatcaagccatcgactaattaaacaagttgcttaagttgaataagatcccagagatggcgatcaagcccatgagtaccacgaatacgttactgatctggccgctgtatttacgcatggccgggactttatgaatggcatacatcggcatcaggaacaggagcatcgcgatgatagggccgcccaatgtttcgatcatccccaagatacttgggtttaaggtcgcgacagcccaggtggtgactaacatgaacaacgcagtaatgcggttcagtttgttctgctcaatggttttgcctctactacgcagagacttaatgaccataccgttaaaaccttcacgggcgcccagatagtggcccaggaatgatttagtgatggcaataaaggcaataaccggtgccatataggcaattactggcgtattaaaatggtttgccagataagacaaaatggagatgttttggttttttgcatccatcagatccgcaggagacaggctcagtacgcaactgaagacgaagaacatgacggtgataaccatcatgatgtgggcaaagctcaaaatgcgtgaacattttttctctgcatccaccccgtactcttcgcgctttgctacagcaaaggctgagatgatcggtgagtggttgaaagagaacaccatgacgggaatgattagccacattgtcatccacaggccgctacctgtgccgttaccgtccatggatacgttttcgaatattgcacctgaccagtttgggatcaggtatatcgccaacatcatcaatacggcaacaaacgggaataccaagatgctcatggctttgacgatggtctgttcaccaaagcgcacgatagccatcaggcccacaatcagaatcagggacaaaatggcgcgtggtggtgatggcaggtgcatctgatgtgtaatgaaactatccacggtattggtaattgctacgctgtacaccaagagaatggggtagatagcgaagaagtaaagcagggtaatcagtttacctgcgcctacaccgaaatgttcttcaaccacctcagtaatatcttcacctggatttttaccggataacacgaatcggcacaggccacggtgagcgtagtaggtcattgggaaagcaatgatagccataacaatcagtggtagcaggccaccaataccggcgttgatgggcaaaaagagtacacctgcgccaatcgctgtaccgtacagacccaacatccacatggtgtcacttttgcgccatgtacttgatgagatttttcttgccgaggcaagagtgcttgtttgcgtagtgtccatgaaaatctccattgtgaacacgttaatttaaaatgaataaccgaaatttagagacccggaatgcattattgaatgacatcatcaggtaagcattcagtcaaaacgatgcgtttaaaatggtgccctggtttattactttggtgctgtagtcgaacaatatgcttaaaaaataagctcaaaaaataacctgaattggcggttgatatctttttatctgatattttagttgttttaaagaacagcttggtttttgatggcggcaagataacgatttgcagtgtaaactaccgtgatcgtgatctcaattgattgataaagtcgaatttggttctttattgagcatttacagcttcttgttacggaaatgtttataactgtatgggtaagaggcataaaaggagatagcctttttacttaacttgtctctcacgcgtgaaaatatattttaatttagagatttgatctagtaaaaatataaattcttgttgttttattgatatttttttaaaaaaaacataatagattttttgtaatttattgattttaattgttttttatttttaaatttgattgggggagattaggtgtgatgcttggattagccggtaatataaacaagtttacagtgggctaaacgtgagctttataataagtgggaataagtgaactctcaaaagagagaattaaacgccttatttgtcatatgaattattattacagacaacttgtcatacaacaacgagggctattttttttactggaatgtgttaaataaacttaaaattttagagaaacgaattttatttttttttattattgggtgttaattaatcactaaaaccctgttttgattttattaaagacaataaaagtttttaacccatatttaaaatatggctatgaacgttagtagattctgtataaaaataatctatggattatttgccaacatagcgctttgatttattcacttatcatcggtgatctgagtgttttgctatcaaaccaaggtgcagtcgacaaatgtgtcgaaagtgaacgcggggttaccgttaagtgcagcagatgcgcattacacgcatcatggtgaaagagtggggttaacagtagatttttacactgtgttgggaaaagaacaggtagaattcagctactggggggcggtccgtcaccagagcatcaaattgcgccaaagtacctatgcttgctggtttaatcttgccaaacttactgtgatccgccaccagtattttatattgcgacttagccatagcacggtgttttagcaagatttcatcaaagttaaaacaagttgcaccgtactcaatggaaacaccggcggctgagataaaggctttgtttgggcaaatattatccagttcgctctgctggctgaggggggtgaaaatgcagttattgggtttgaactccccaccgcacaggatcactttgcagttaggcttatcttgtaaggcaaggaaggtgttgagagagtaacagatggcagtaaatgccagctcttcatctatctcatcaataatccaggggatagtcgtcccacagtcaaaaaagacggtatcattttcaataatcagttgtgccgctaactggccgatacgacgtttttcttctacctgcttagcttgttgatcagaaacaaaatagttgttggcattgttactcttagggtccatcaccacgtaaccgcccagcaaaatgacggacgtgggttcggcactgagatctcgccgaatagtcatttcagatacacgcaacagattggccgcatctttcaaatggattttgtcggaacgcttaagggcctgaataagtttattgattcgttctgcgcgacgagtttccatcagcgattcccaaggttatatgttgtaattcaacttattatatacacagtacgataataaataagcccggtaattgtggaccgggctcagactactgacaaaatcagctgaaaggaaaacatgccgttgggcgtcgtgacgtaaaccaccgggagcagcccaaggtgcggtcaatcttttatatatttttcaatcacgcttatagatttttcaaccacggtcagtacattctagtaacctgatgcggcggcttgttgacctgaaacaatggcaactccagagctggtaccaattcgcgtagcacctgcctggatcatggtttcggcggttgctctgtcacgaacagcaccagaggctttaacccccataaccgggccaaccgttgcacgcatcaatttgacgtgttcttctttagcgccaccggtactaaaaccggttgatgttttaacaaaagcaacgtcaagttcacgacacatttcgcaaacttgtacaatttgttcatcgctgagcaggcaagtttctaatattaccttcaacggtgtagcggcgcaattgtcccgcacggccttaatatccgctttgacgtcggcaattttgccacttttcagccagccaacattgataaccatatcaatctcttgtgcacctgcattgatcgcggcttgagcttcaaaagcttttgctgcagtcagacctgcacccagcgggaaaccaatgactgagcagactttgactgaactcccggctaattgctgggcagccacaggaacgtatccagagttaacacatacagcatagaaatggtgttgtttagcttcttcgcacagtttaatgatttgcgcttcggtggcatccatcgccagtagagtgtgatcaatataatgagcgtaattggtagtcatgattaggatccttgagcttattggtagttgtgataatcataacattttgatgagtaaaaaggagcgacacaccgtgaattcatgaattttgttatttaaattacatttttagttgaaataagacgaaaaaaccaatgaaaaggtttcagtcgcttgttttggggcctttgagcagggtttggagggagataagggcgcatggagagattgccggtcagagactaaccggcaagtgtgaagcgaataccgtgaaggggctaacctctgacccaccctttactgattggtagggcaaaactcatgtgatagaagcgctttgtggtactggcaataatttccccaaataagttccaaaccagttgcgcgaacaagcagccgacaatacctaacagaaacgcacccagcatgtcgaatggccaatgaacacccagatagatacgtgaccaggcaatcgcaatggcgataaacatcaggctgacaccggaccaaaggtgatgccaaaaaagaaaggccagtgcaaaagtgaaaatagcggtgccgtggtcactgggaaaagagctgtctggcgcatggctcataaaggcataaccaaagccatcgacaaaaggccgatcatgaggaatgagcatcccgatacaggtagcagaaagcatggaaaaagcgagagcgatagctgctttcgtcaccacagtacgttgcatgtccatggtatcttttggcccccatagccacagccctatcagtaaaatagggatgagcataatcaggtcacgtgcgatgaaagtcgcaaaagaaatcatccatggtgaggatgctggcgttgcgtttatcatggagaagaaaaaataattcatttgttccattattcagtacctttaatgcgctggtaatagccgctaatcatccaaaatgcagccaactgactgagccatacccaccaacctgcccacaggttatgagtaagaaaatgcgccccgcgcattatttgaccgaaacccatcaacatacccagtccaataccggcgaaccaacacagcatcgccaaccgtgggcgttcggggtaaaacaagaaaaacagtgccatgaccgcaaaaccgctggaagcatgaccaccaggaaaacagtgaccagggccagcacccggtggggcggtatccatcaggacataattgagcgctttaccgccatactccaccagatcccaagggcaggagtgtgcactggtggctttcaaaataccgatcaccaatggaccgaggccaaataacagggcggtggtgactaaacgcccatttcggcgataaatcccccacagcagtgcagcaatagcggtggcgattagggccattttgagcagccggtgattcagtaaatcgagccatttattgtgttcccaagggaaattctgcccgacgggatcgaaccaataattactgataagccaatccagttgttcactacgtgacaacgctaaaaagagtagaccaaccagtaacagcccaaaaacttgccaaaaatagaaggataaaggcaacgagtaaagggagattgtcttaattgttggtactgttgagcgattatttagtgttgacggaccggtactggcttgtcgggtagttttgctgatcttcacagtgtgacctgaagcagaagtcgcgaatagaggtactgtaatcattttgtcttaagaaagccttaaggggcgaggagggaaagtctggagaaaatgtgaaataacagtgatatacctgccatgctgcaaactgcatgtgcgttggccgccttcctgcaacttgaattatttagggtataaatgtgcaaatcttgaatttcagacaagaaaaaacccggttagtcttgaacctaagaaggcgggactaccgggctcctcaatatggggacatcaaagaaaagcagtggcattaattcagacccccgcctgataagaaagttcgggggaaatgaaaaaaggataaaatagtatttagatttaccccgggcctcttttatctaacctaatatccctggccagaggatgacaatcaacgagccagccaaggtcagtaagacgttggcgatagcgtaagtccccgcgtagcctaatgcgggaatattgctacgcgcggtatcactgatgatgtccatggcgggtgcacaggttctggcccccataatggcaccaaaaagcagtgcacggttcatacgcagaacataagcaccaaaaacaaagcagatcaccaccggaaccaaactgactatcaaaccggaaatcaacatttgtccaccgacggcgcccaggctgctattaatgccgcccccggcacttaacccgacacctgccataaagaccattaacccgaactctttcaccatattcaaggcgccttgcgggatatagccaaaagtagggtggttggcacgtaaaaatcccagcatgatccctgctaataacagccctgcggcattgccaataccgaagctgaaattgctgaactggaaagtaatcaggccaatcattaacccaagaataaagaatgagcagaaggccagcaggtcagtgacctgactgtgaatagagataaagccaattttttctgccacgcttttgactcgccgggcatcaccactgacttgcagcacatcacctttattcaacaccacgttatcatcaatgggcatttcaatttggctacgaatgacccgattaaggaagcaaccgtgatcggtgagttttaaatggctgaggcgtttaccgacagcattgctatttttgaccacgatctcttcggtgacgatacgcatatccaacagatcacggtcgaaaacttctttgccattacggaagctggggtcaaggcgggaatgggcatctgggtaacccaccaacgagatttcatcaccgacttgtagcacggcgtcaccatccggattcgcgagaataccgttgcggcggatacgctcgatatagcaaccggtttggcggtaaatccctaattcacgcaagtttttaccatctgcccaggcaaccagctccgggcctacacgataagcacggatgacaggcaaatacactttacgctggctatcggtgtccagccctcgttcgcgggcaatttgttgggcgctggtcggtaaatcctgatgctgaagcttaggtaaatagcgcgcacctaaaatcaggctaaccagtccgataagataagtcagggcatagccgaggctcaaattatcctgtgcttgttgcagtgacgaaccattagccatggtatggcgtagcgtatcaccggccccaaccaaaacgggggtcgatgtcattgaccctgccagcatcccggcggtcagaccgatatcccaaccaaataatttgccaagccccaacgctaaaatcatcgcgctgcccaccataaccaaggcgagcatcaggtaatttttgccatcacggaagaaaatagaaaagaagtttggaccggcttcaacaccgacacaaaaaataaacaacataaagcccagatttagcgcttcagtattgatggcgaaatgctgttgccctagcaacagtgataccaccagtacaccaatagcgttacctaattggatagagccaaggcgcaatttacctaagcataaccccaacgctaagacgacgaataacagcaagatatagttgccgtttaataaatttgcgacgtttatattcacaggatgtttatattcacaaagtatgactttttattaagtctaggatagttaaatctaaatgattcactatgcacccgttcttccataaccagagagaacgacacatctctttagattccacccgtgaatcgctatgcgagagaaacagacacggaagaagcagacagatgatagcggggcttattctagtcggtctgttgcaagacagccagtagtaagcagaaagtttagtattaccagatgagatcactagaatggaagtagatgatggttttatctactgaaaatgagtgagtgttatatttttttaactatttggttatcaccgaacgaaataccagcaataaagaaagggtgtcttggacacccttatcggataaatgcggtcactgccacgttgcctgtcagattacttatacaggctcaaatgttctttggcgtaggcttcgaaatcagtacagccgccaatgtgtttttcatcaataaagatttgtggcacggtttcaaccggtttaccgaccgttttttccagatcagctttggaaatgccttcggcatgaatgtcgacataacggaatttaaaatcgtcacgctcagatgccagtttctcagctaactctttggcacggacacagtaagggcactcaggacgtccaaaaatcacagcaaacatgcaaaactccttgattaaattgagataatcacttcgtcaacagttactgatatattcaactgttaaatgacatttggcgtattactcatttttactggggtctactatgcccgttggtacggtgaaaaaaaagcaggaattacctgttagtttgattaattttatctatttgcttcttggtgctgttacaaattgtatggattcaatacactggctatacccgtcatacttcaagttacatgtgcgttggctacgttcaataacccgaatcacttactggtcgttgacgttaaaataaatagattcatcgggattaatgaacctcgtctttgaggctcagcctgcgggcagcattaatgctgttcaaatcgggtttccaaggatttgtctctcgcttgccgccttccgcaactcgaattatgttgggtataaacgctcatacagagcctgtcggaggaaaagatgcgctcgttaggaaatatgccccggattgtgatcatttcagaagtactggggttgttgttattggttgttgcttatttaagcatcaataattatttgtcattgccaggggaaatggggacaccaacggctgccattatgatgatttttgtgggggtcggcctgatgatcccggcggcagtgtgtatcgtctggcgggtagccagcggttttggtccattattgggcagtgctgacagaatatcgacgccacagaaggcgtcagaggaaaaactggcggcgaaaagtaaaaaatcgggtcaggataaccactaagattttataagcacattgagaatatctaagccgaggaacggcccagatatcaaattagtcgggattgatcgtagcgctatcggccaatattccgtaagctatgccacttttcgtattatgagcatcgtgaggtaggttgttatggattcactcatcgtccctgatttagccttattacggcgttggctggatcagctcggtatttccttttttgagtgtgactcctgtcaggcgctccatttgccgcacatgcaaaattttgagggtgtgtttgatgccaaaattgatctggttgataacattatcttgttttcggcactggccgaagttaggccaaccgcgttgatccccttggtcgctgaccttagccaaattaatgccagctcactgacagtcaaagcgtttatcgatattcaggatgacaatctaccaaaactgattgtctgccagtctttggtggtggaagttggcgtcacaattgagcaatttggctacttcatgcagcagtgtgaagagcaaatctcgatgattattatggaagcacgggccaatgacttgttgtttattggcaacaatgacgaagaggaagcaccgttaaccgccacctcttaccccatcattcattaatttatatccccaatacggggtgtgtgaatgagcgtgccagaatgaacgtgccagaatgagcgtgccagaatgagcgtgccagaatgaacgtgtccgaataaacgtgtccgaataaagacagtgtgccgcagatatcagcggcacgcggctattttctctatttacgggtcatgaccctctacttacctaacataatcccctactcaccataagatattctgctttttgccctcctttgccagatatctatcgccgtttgtgccatgagtggcgcattacatagatagaatatgcataaaaaatcgataaaaggcgttttttaccctagagtatggtacagattacgaactgcggttatgctgctatttctgccaagggcataatattcccccgtgaagtcagagattactcttaccaagtaaatagtcacttaccgtgcatagccatgcatcggtgttgggtgatgacggtgctcggaaggcaacggcgttgtatctcatcagatacacatttaacgcactattttaccccctgttttggaggagtttacggatgttcacccaacgtaaaaagtggttatcgggtgttgctgccggtctgttaatggccgcgtccgtctcagcatctgctgaagagaagatattgcacatttacaactggtccgattatatcgctccggatacgctggctaatttccaaaaggaaaccggcattaaggttgtttatgatgtgtttgactctaatgaggtgttggaagggaaattaatggcggggagcacagggtttgatttggtggtgccatcagccagtttccttgagcgtcaattgtcagccggtgtctttaagccactggataaaagcaagttaccgaatgagaaaaatctcgaccccgagttactggcgctggtcagcaagcacgatcccgataataaatatgccattccttatctctgggccacgaccggtatcggctataacgtcgagaaagtgaaggcagtgctaggagaagatgcgccagtcaatagctgggatttggtgctgaaacccgaaaatcttgagaagctgaaaagttgtggtgtctccttcctggatgcgccgagcgaaattttcgctacggtactcaactatttaggtaaagatccgaacagtacactcactgccgattacacgggctccgcgacggatttattgctgaagttgcggccaaatatccgctatttccactcgtcacaatacattaatgatctggcgaacggggatatctgtgtcgctgtgggttgggccggcgatatcatgcaagcctctaatcgtgccaaagaagcgaagaatggggtgaatgtggcttacagcattccgaaggaaggcgccttagcgttctttgatgtgtttgcgatgccaactgacgctaaaaatcaggatgaagcttaccagttccttaattacctgatgcgccctgatgtgattgcgaatatcagtaaccacgtgttctacgcgaacgccaaccaagcggctacaccgttggtgaacgcagaggttcgtgataatccagggatttacccgccagcggatgtacgtgccaaaatgtttacgctaaaagtgcaggatccgaaaattgaccgggtcatcacccgggcctggacaaaagttaaaagcggtaaataagccgttatgatgaatggatagggtgcggctgacgtactttactgttcattcattgacggtaaaaatgaaattgatcctggtaggggcagggagtttatcttcctgttcccgtctcttattgcgccgcacgttaaatgcggcctgttctgcttttacggagagcacgctgagtgaatgatgttattccccgcccacagccaaaatcccagaaggtgtttacccctttactggaaatccgtaacttaaccaagtcattcgacggtcaggcggctgtggatgatgtcaatctgaccatttataaaggtgagatttttgcgctattgggggcatcaggttgtggtaaatctaccctgttacggatgctggccggttttgaacagccaacgcaaggccagatcgtccttgatgggcaggatttatcccatgttccaccgtatcgacgccctatcaatatgatgttccagtcttacgcgctattcccgcacatgaccgtggagcaaaacatcgcattcggcttgaagcaggataagctgccgtctaatgaaattaaaagccgggtcgccgagatgctgacactggtccatatgcaagagtttgctaaacgtaaaccgcatcaattatccggtggtcagcgccagcgtgtggcattggcacgtagcttggctaaacggccaaaactgctgcttttggatgagccaatgggggcgctggataaaaaactacgcgaccgtatgcaactggaagtgttggatattttggagcgggtgggcgcaacctgtgtgatggtcacccatgaccaagaagaagcgatgaccatggccgggcgcattgccattatgaaccggggcaagtttgtgcagattggtgagccagaagagatttatgagcatccgaacagcagattcagcgctgagtttatcggctcagtgaatgtgttcgaaggcgtgctaaaagagcgtttagatgacgcgttggtgattgatagccctggcctgcgccatccgctaaaagtggattccgatgcctcggtcgttgacggagtgcctgtgctggtcgccctacgcccggaaaaagtgatgttatgtgatcaggtccccaaagatggctgcaattttgctgtaggcgaagtggtacacattgcctatctgggcgatttatccatttatcacgtgaaattacacagtggtcagatgctaagtgcgcagttacagaatggtcatcgctaccgtaaaggcatgccaacgtggggtgatgaagtgcaactctgttgggatgctgacagttgcgtggttttagggagctaattaattgtttggggagccaatattgtgataccagaatccacgagtggggccgcagaacccccgatccgctcagttgggccggtcagggcgctgatacaacgcttccaaatggcgcatggccgtaaactggtcatcgccatgccatatttatggctattcctcttatttatgctgcctttcctgatcgtgtttaaaatcagtttggcggaaatggtgcgggcggttcccccttataccgatctcaccacttggctggacggcaagctggatatctcgctaaatctgggtaattacctgctactgctggatgatccgttatatatcgatgcctatttgcaatcgttgcaagtggcggcggtatcaacgctgtgctgcctgcttattggctacccattggcttgggcgattgctcacagtaaaccatcgacccgcaacatcttattgctgttggttatcttgccgtcatggacgtcatttctgatccgggtttatgcctggatggggatcctaaaaaataacggcatcttgaataactttttaatatggaccggaattattgatcagccgctagtcatcttacacaccaatctggccgtttatattggcgtggtgtattcctacctgccatttatggtgttgccgatttataccgcattaacgcgactggattactcgctggtagaagctgcgttggatctcggggccaggccgttcaagacgtttatcagtgtgattatcccgttgaccaaaggcggtattgtcgctggctctatgttggtatttatccctgcagtaggggagtttgtgatccccgagctccttggtgggccggatagcatcatgattggccgcattttgtggcaggagtttttcaataatcgcgactggccggtggcctctgcggtggcaaccgtgatgttagtgctgctgattgccccgatactctggttccacaaacatcaaaataaagatattgggggcgcgagatgaataacttaccggaggtgcgttctgtctggcgtcgggtgatcctgaccgtcggttataccttcctgtatgccccaatgttgatgttggtaatttattcgtttaacagctcgaagctggtgacggtgtgggctgggtggtcaacccgttggtatacgcagttatttaatgattcggcgatgatctcgattgccgccgcctctgccactatggcggtggtgttggggacgattgccgcggtggtcatggtgcgctttgggcgttttcgtgggtcaaccggttttgcttttatgctgactgcaccgctggttatgcctgatgtcatcaccggactgtcactactgctgctgtttgtggcgatggggcatgccattgggtggcccgcagaacgtggcatgttcaccatctggctggcccatgtgactttctgcacggcctatgtgacggtggtcatcagttcgcggttgcgcgaattggaccgttctattgaagaggcggccatggatctgggcgcgacaccactgaaggtcttctttgttattacggtaccgatgatcgcccctgcgctgatctctggttggttgctggcctttaccttatcccttgatgatctggttattgccagctttgttgccgggccgggggccaccacgttaccgatgttggtattctccagtgtgcgtatgggggtgaatccagagattaatgcgttagcgacacttatcctgctggtggttggggttatcggtttatttgcatggtggataatgtcgcgtgcggaaaagcagagattgcgcgaattacgtaaagctgctcgtagctgattctccctaaagctgttagtctttcgtctcctttaacgccgctttagagcggcgttattgtgagagataacatcaggttgcggaaaaccgattatgagcatcagactgggggtaaccaagcaatatgagaccgtccttttcatcctcagcagcaacgcctgtccctgtcgtcattggcggaacggctatcattgcgacccgaatcatcggcgtattgctattagtggctgaactgggcttcagtggtgttagcgattttatcagtgatagcttgcaacgttgggataccggcttgattttttttgccagtattgtcttgctgttgttggatatggtgtgtggtgttgcggtgtgtcaccgccgaaactgggcgcgctggtattatctgatttgtcagttgatcatcatgatttacctgcttatggcttcactgaattggttggagccagatattttccgcattgaaggcgatagcggcgctgaaatcttgcacagtttgcttttgcaaaaaatccccgacgtggtgattatcgggttgttatttttcccctggcaccgctatttcccccagtcaaaaatgagtgtttaacgccatagggtgctacaatccgcgcccatcgacagcttcggctgcacattatctactgtctcagagtataacggtcaatattaatgcattgcgcacagtatacggcaggtcgctgccgttcttgtcagtggttggataaaccctatccacaacaactcgctgataaacagcatcatctggaaagcctgttggctgggcatgcggtcacccagtggctagcaccggtttttgggcgcgaaagtacctttcgtaacaaggcgaaaatggtcgtcagcggcagtgtggaacgcccgttactgggtatgctgcatcgtgacggtacaccggttgatttatgcgcatgtccactttatccgcccagcttcgaaccggtatttacggtactgaaaacctttattgccagggcgggtttgactccctataacgttgctcgcaagcgtggcgaacttaaattcctgttactcacggaaagtacctacaacggtgaattgatgctgcgctttgtgctgcgttctgaaactaaattagcgcagttaattgctgcgttgccgtggctgcaacaacagttgccgcagttggcggtgatctcggctaatattcagccagtgcatatggccattctggaaggggagcgggagatcccgctgaccgaacaacaggccctgcctgagcggtttaatcaggtgccgttgtatatccgcccacaaagttttttccagaccaatccaccggtggcggcttcgttgtatgcaacagcacggcagtgggtgcaggagcatgaggttcacagtatgtgggatctgttctgtggtgtgggcggctttggtttacattgtgcggggccagagactcaattgaccggcattgaaatcagtgctgaagctatcgcctgtgcccgccagtcggctgagcagttagggctaaaaaatgtcagtttcgccgcgctggattctacccgctttgctaccgctgaagcccaaatacctgaactggtcttggtgaatccaccacggcgggggatcggccgcgagttatgtgattacctgagccagatggcacctaaatttattctctattcaagttgtaatgcagagacgatggcgaaagatatcagtttgcttgcgggttaccacattgaacgggtacagctgtttgatatgttcccgcataccagtcactacgaagtgctcaccttgctggctctccgtcgctagacgtggtttgtggcttaagtgagtatgcagtgagccaaagtcaaagcgttaaaacgttaaagtcactggcgttgcaggtcggcagctaacaagcgcatccccctgcaacgtcaaatatgaaggggattattgagggaaccacttatcattgatcgcttgataagtaccatcagctttcaccgcatcaatggctttattcaattttgtcagtagggcgatgttatccgggcgcacagcaatacctaaaccggtgccgaaatattgtgggtcggtcacatgctcgccgacagaggctaaattaggattggttttcagccattcattcactaccgcagtatcaccaaacacaccatcaatacggccatttttcagatcaatgatggcattctggtagctgtcataagacacggtctgaatttcaggatgtttatcctgtaaatatttctgatgggtagtgccattctccatcccaatttttttgcctttcaggtcagcaaaagtgctgaatttaccttttggggcgataacaatcgcggagttagcgtagtaaggctgagtgaatgccacctgcttgctgcgttctggcgtgatatccataccagagataacggcatcataacgtttgaatttaagcgctgggatcaggctatcaaaagcctgattagtgaaagtacagttggcttccatttgtttacacagtgcttttgccagatccatatcaaagccaacgatttcgttattggcatccatagattcaaatggcgggtaggtggctgaggctgcaaaacggagggtctctgcggcggtagcgctgaaaaccatgccacttaataacgttgccaatagtaattttttcatgcttaagctcctgtctgaatttttcaatagaatatgttattagttattgattttattgtatctggtttgtttttttgccaaaaaagcccctgtctgatgggatttacattgccattttatgaatttatatgcaagtaatgtgattaaaaatttaaatttattctctgggaaaatgagtgaaggagtagacgctggtgaaagtgcagaaactgatgaccgtgcggaaactgagtagaggttgttagcatgactggcaataacccattccccccatcgctaatatggtttggctcaatgaggatgagtgcctaaatcatggggttaatacgatgctcgtggttaatattgcctcaatgaagattagcgttattgttttgatcgtttctggtattagcatggtgataattttattatcatttgttaaatgataagactttcattatataattatattattggtgagttttaataataaaaataggacatatcttgtataaatttattttgataacggtataatgagggtgagcaacaggttgataacaaaaatatagaatagggagtgattttttattatccccgctcgggagtttttcattaaaaataaaatatcaattacttaaagtaaacgcattgcttgtatttagagtgacaaccaaataaaacacgttcacatataaaataaataatagaaataacaatattttttctatttgagatttttattttttagatataagtatttttattaaaaacagggtgtattcatatgacaatgaagaaagaaatgtccatgagatttgttactgtgtgtggctttctggcgatattaacattaattgcggttatttgcttgatgggaagttggtacaccattaatgaaagcgacagaggcatcattactaaatggggaaaagtggtcgctgtggctgaaccgggtcttggctttaaaatacccataattacagaagttgaaacaatatctatttctaatcgttcaattaaatacgacagactaaaagcatacagtaaagatcaacaacctgcccaaatggttgtgtctattgggtttcaggtcccacctactagcgttgaagatctctttgtaaaatatggctcgattcaaaatatggcggagcgcctggtaagccgacatgttccaacacaagtagaaaatgtatttggccaatacaccgcagtctctgctgtgcagaacagagaagattttgttagacgagtcaccgaagaattaaggcgggtgcttaaagacgaacctctcattattaattccgttaatatcgaaaatattgattttaccgaagggtatgaagccagcatagaagagcgaatgaaggctgaagttaatgtcgaaaaaacgcgaaaaatgttagagacagaaaaaattaatgctgacatcgccattgaacaagcaagaggtcaatccgagtctcaattaagtattgcaaaaattggcgctgaaaaaataaaattaatgggtgcggcagaagctgagaacatcagattaatgggggcggcagaagccgaagcgataaaattaagagctgatgccttaaaacagaatccattgttggtcgagttaattactgcagaaaaatggaacggagagttaccacagacgatgctcccaaatagcagtgttccatttattaatgccagaaataaagacggcaagtgatttttgatagttaatcaataaatctgaagcccacttccccatggagattcgtggtgtagtgggcttttttatcatctgtcattaaaaatgtagagtttgtcattaaccccccttgttgacatacccacgccagtcgagcgcagtgtctctgtatcagcacctctcattaggcccacaatagcaattcattaggcccacaatagcaatctagactgctgataaagtcaaatgacggggaaacgtgccgttggggtcgtacgtggcgtaagccaccggagcggccctgatatcttgatctaggtgcggtcacccttcactcactgagctttgccatcagcttcgatctttttcttgagcacaacatttaattgatacattataacataacaatcaaatcaacgagaatatcctttatgttattacgtattttttggagtttatgcctctggtgggggatcagcagcagtgcgctggcagagatccatctcaaagatgttgatggtcgtgaggtcactctggcggcaccagcacaacgtgtttatatcggtttttattatgaggattttttggcgatcaatgggccagacagttatcaacatgtcgtggccttctctaaaagtgattggagcctacggaccagccaatggccgcgctatcaggcagccctacggcgtttaagccaattggtggatgttgggtctttgtataaccaaagttttgactttgagcgcctgctggcgacccggccagatttactgattttggcaaaatggcaactcgaaggcttcgccaactatttgccggtattacagcaactctctattccctatgtcgtggtcgattttaatcagggagaggacgctaagctcaccagtattcgggtaatggggcaagcattaggtcatggcgaacgggctgaacgcttggctatcgcctatcaacaaggcattgcagatattcgcagacgaattacccaagcgaatttgccctcgccgaaaacctatattgaactcggcgataaagggccgggtgaatacagcagcagctatgggacgtctatttgggggcccttacttcaacaggccggtgccaacaatatcgcgacaggcgtggtcaccacaccttctccactgcgcgcagagtatgtgttatctcagaaacccgaggtgatttttctggcgggcggagactggccgaaaatgccgaatgcggtgtcgatggggtttggtgccaaacctgaaaccctccagcaaagtatgacccaatatgctcagcgtcccggctggtcacaatttcccgcgattaaacaaacacgtttttacgcgctctatcatggcggcgtccgcacgttgtacgactacatttttgtgcagtttgtcgccaaggcgctttttccttcggcatttgaagatgtgaacccgcaacgtaatctcgaaacgttttatgaagagtatctgcccatcaaagccgatggcgtatttatgcagcaatggcagggagaataatggcaacctttttagagcccctcacgcagggacggcaattttttcagcaacttcatctacgacgcgggttattcacactggcattgattggctcgctactggccgctatggtcatcgatctggccactggtgcggccaaccttagcccacttgatgtattgcggctgtttctggtggattcttcgcagcatgatgaactacaccagatcattttttggtccattcgtttgccgatgacgttaaccgccgtggtggtgggcgcgagtttgggtttggctggcttgttgatgcaaaccgtactggcgaatccgttagccagtccttataccttggggatttcagccgcggcaggatttggtgccgcattatcgatcatcactggcttcagcgtggggggagtcttgtcattaggcaccccattattggcttcactgatggcattactggcctgcctgcccatttactttatgggccaacggcaggggatgacaccgcaaattctggtgttgagcggcattgtggtgctgttcttcttccagtcgttgcaatcactcatgttatttctggcctcaccagaagcgatgcaacaaattgtattctggctgtttggcagcctgctaaaagccaatatgcagggggtgctaatgacgggcagcgtactggcttgttcactggttatctgtttgcagcaggcatggcgattgaccgcgctttcagcgggggaggagcaagcgctaggtttggggattaacgtaagcgccttacgtaagttagcgtttcttctggcgaccttgttgaccgccgcctctgtgtcttttgtcggcactatcggctttatcggtttggtcgcccctcacttcgcccgtatgttggtcggcgaagatcaacgctatctgatcggtatttcggcactttgtggcagcctgctattggttctggcctctatcatttccaaactcatactgccaaatggtgtcgtgccgatcggcattattattgcgctgatcggtgtcccggtattgttctattttgtgactaaacaggtgaaacgggcatgacgcaactgacgttaaagcacgtcggcgtcacgcttcataaacgcccactgctcaccgatatttctctaacgtggcctgcggcacaggtgagcggcattattggccccaatggggcgggcaaatccacgttactcaaagccattaaccacatggtccccattaccgggcagatcgaatatcaacagtgcccactgaatacgcgcgtcacacgcatcgcctatgtgtcccaactcaatcgtagtgattctgccctgaccgtttttgaaatggtcctgctgggtaaagttcgccaattgagctggcgtgtcagccccgcacaaattgatgcggtcgagcaggtattggcagagtgcggcatttcctctctggcaaaccaagttttcaacagtctaagtggcgggcaacgccagttagtgatgctcgcgcaggctttcatcgctcagccgcagatcattttgctggatgaaccgaccagcgccctggatattcaccaccaattacgtgtgctgcaaaaaatcgtcgattacagcaaacgccaccaatgcaccacattaatggtgatccacgatctgggcttggcgctgcgcttttgccaaacgctcacgttaatccaccgtggaaatgttgcctgtcatggcgcagcccatcaggtgatcgcggaccccatgatgtccaccgtatttggtgtgggtatcgaaagtggaacaagccctttgggctatcgctacttattgcccactcagttcttacctactcatggagagaaaatatgtatacgttgatgaaagccgatgtgctggctcaactcgcggggctgcagcaagaaatcagccagttacacgataatgcccagcaaaatcagtctcattttgtgttgttagagcgccgttttagtcgcttgcagtcttttaatgacgagccacagctacaagattaccggttgcagttggagcacgatgatgcggtggtaaaacaaattgcccaattgcggcaggtcgccaatgcggcactgtgtgactatgaaaaacatcaggtatgcgccttgtgtggcccatcctccaagactgacgactacctgacaagttttaaccaatcgctgcaacaagagatcaaactcgccggtatgcagatgggtgagaaggtgttgttggtgggcagcggtgccttgccgaccacggcgctggtactggttgccaagctcggtgcaaccgtcttttgctacgatcacgatcccgccgcacagcagttagctcgccagctcgttcaatccctcggtctggaaaaacaggtgcaatttattgataacctgaaagagttaacggaccgtcccgttgaccacattatcgtcgcttcattggtggcggataaacaggcgttattagcacaattggttccctatgtgacccggtccagcaaattagtgatgcgctatggcaatgggctgaagtctattttcaactgcccttattgccatgaggcgaactgttcacattggcgcaccgccagtaaaccggtgaccaccgggctttatgaccttatcattttggaacctaatcatcatgcataacaccctgccgaccttgattctgggggccgggcctgcggctatccaacttgcggtggatattagtgctacaggtgatgctcggttggggctctataatcggcccagcacgaaaggcgaacggttaaagcagtatctggcactcacgccgaccctttatttgcagggtaccggcaaggcacaagcgacccagaaagagagcagtgtcacgattgattgctatatcgatcaattggcgcaggcggttggtgattggcaacgtttgattttggcagtccctgccgaccactattacgccgtcctacaacagattccgtgggccgcgttgccacaattaaagtcagtgattttactgtcctcttcgatgggttccggcctgatggtgcagaatctgttaaacgccgcggggaagcgcgatgtcgaggtcatcagcctgtccagttattatgcggatactaaatatattcgcgctgaaacccaagacattagcgctaatacccaagacattaatgctggaacccaagacattggcgctatacagccttatcgggcgtataccaaagcatttaaacagcggatatatctggccaatcagtggggtaatgcgggatcggcagagatgagctggttaacggcggtattagcccgccaccacattgacaccttaccgtgttctaacttgttggccgccgagcgttttagcattaccaattatgtccatccccctttggcgctggcggataccacgttgcaggcgctgttctatccagagcaacgtagccagtatctgtataaaacccaaccagaagggccggtctgtccggcggtgattgcggatttagcgggtttggccgatgactataaaaggctcctcaaccggctaggggtggaagaaatcaacttgctacgttttctcaatgacgataactatccggtgcctgcctccatggtcagtcgtcgctggattgacgaatttccacagcttccccctcttgagcagcaatacgcgctgtttgttcgttataccgccttgttagtggacccgtactctacaccggatgaacaaggccgattctatgacttttcggcggtcaaggtggccacggtatatcaagacgcgaatgcgctgtggcatttgccgcgagtgccgctggaggatgttcacaaattgcgaacgctgctattactggcgggcgcgctggatgtggtgatgcccacagcgcagcggctgctacagcgattccagcaggcgctcaaggcgtttattgaccgggtcggtgaggaacattgccatccctctttattgggggacgattgtgacaggcaggcggccatcatcgaacaacaatggcggagccagacatgaaccaaggcgcgttattggctattctcgcctccctgattttcagcgtgatgaatgtgttagtcaaaaccatcgctgatgaaattcctaccggtgagatcgtgttcttccgcagtagcattggttgcttgttgattgggttactgatgtatcagcgtgggatagcgttcagccgtgaagatcgcccattgttggtactccgggggacgatgggcgcactgtatctgatttgctatttttacagtattgctcacctgacattggcagatgccagcatgttggcctatctgtcaccgtttttctcgattgtgctgtcattactggtgttgcgcgaacgggtgaatgccaccatggctttctggttggtgatggtgattattggcgcgattatcttgatccgcccgtggaatttttccacctatacgttggcgtctctggtgggggtgatgagtgcggtatttgcggctattgcttatttgtcggtgaataagctcacgaagcgccatcacaattatgaaatcgtcttctactttttgtttatcgcgacgctgatctctatcccactgatgtggcataactttgtttggccgagtgggtatcagttcggcattctcatcgccattgctcttgtctcattgctaggtcaggtggttttaacgcaggctttctcttcggacaacctgatcgtggtgtcggtggtgcgctatatcggcattgtcttcaatattacctggggctggctattttgggatgaggtgccattgatgttgtcgttgatggggggcgggttggtggtggtatcgtgcattcaattggggttacgcagtaaaaagaaggcggcctgatattcacacaaggcaaactgatcgttataccccaaataattcgagtggcaggaaggcagccaacgcataggcagcttgaagcatgacggttagataaggcagatcgcaggggcggggcgttaaggaaaccggatcatcacgcaatttctggttgatgatccggcgttgtcgcataaggggagagtgcagcataaggggcgaggccgcttaattccgtcgctcaaaggccagagctttacgctccactaaccgcatcagcaacgtcagcaagccattcacgcacaggtaaacaaccccggcggcaccaaacaccatcacgtcataggttcggccatacatcagttggctataccccatgacctccatcaaggtgatagtgtatgccagcgaggtccctttgaagaccaagaccacttcgttggaataggatgatagcgcccgtttaaaggcaaaaggcagcagaatacgtaacgattgacgttttgacatccccagcgcttcacaggattgccattggccagagggaatagcccgtactgcaccgtagaacagttgagtggtatacgccgcactgttcaatgccagagcaatcattgcgcacagccatggctgtgacaacaggctccacaaccacggatattcgcggattgccgggaattgccctggaccgtaatagatcaaaaagatctgtaccaacagcggggtaccggtgaacagggtgatataaattttcaccagcggggtggcaatgggggttttcagcgtcagaacgatggtaaacaccactgacagcaccaacgccaccagcaaagagacgatggtcaaggtcaggctggtatgcagccctttcagtatctcgggtatatattccaacatcaggatgcgctccgctcaaaacgggtggtacggagttcaatccatttgaggacatactggctcagcagggtcacgaccaggtagattgctgcggcaatcacataccaagtgaagggttcctgtgtccgggtggcaatacttttggtttgcagcatcaggtcattgacactgataagcgacaccagcgcggtatctttgagtaataccaaccattgattacccaaacctggcaaggcatgtcgccacatttgcggcataatcaaacggaagaaaatcgccgtctggcttaaaccgagtgcctggccggattcccactgcccgataggcaccgcttttagtgcgccgcgcaatgtctgcgatgcataagcggaatagagcagggccagtgcgatcacaccgcacaagaatgggctaacctcgaaattatccagattaagcttaatgggcagctcaaacagatagagattcagcgtgaaaccgtccgacaacatcatcaacagctgagaagagccgaaatagataaacaggaccaccagaatctcgggtaatccgcgtaaaagagtcacccaaccgatagtcaggtaactaaccactttcaaacgtgatgattcaccgacggcaaacagcatcgccagaaccaaaccgagtgccagtgcacaaacggcaaggccgacggtcataccggcggcacttgctaaaggttgaaattcattcatgggtgtttagattactgctggaaccattttttatagatagtttgataggtgccatcggctttaactttcgttagcgcagcatctaacttaccctgtaattcggtgttgctctggcgtaccgcgatacctaaaccggtaccgaaatagtcagcgtctgtcactttgtcaccaaccgccgctaattggtcattctgtttcagccactcattcaccactgcggtatcaccaaatacggcatccaaacggccatttttcaggtcaaggatggcattctggtagctgtcataaggcacagccgtgatttcagggtgtttttccatcaagtatttttgatgggtagagccgttctgcataccgacacgtttgcctttcagtgcggctaaatccgccactttatctttttgggcgataaacagcgctgagttatcgtagtaaggctgcgtgaatgccacttgtttctggcgttctggggtgatgtccatacccgaaataacggcatcaaaacgtttgaattttaggcttgggatcaagctatcaaaggcctgattggtaaaggtgcaatcggcttgcatctctttacacagtgcattagccagatcgatatcgaagccctgcattttattattggcatcaataaattcgaacggtgggtaagtggcttccgcagcgaaacgaatggtttcagcggcagaggctgacaaactgatactggcgaggacggtcgctattattaattttttcatcgcaaattcccaaatagatatcaatgtgacagatagctggcaaaagcttcggttgttggttgggtaaagtggctggcatcgccctgttccacaacatggccgttttccatgtaaaccacacgactggctgtcttgcgggccacttcaacctcatgagtgacaatcacctgagtaataccggttccggctaattcacggatgatgctgacgatttgtgcagtaatctctggatcgagcgcggcggtcggctcgtcaaacagcaacacttgcggttccatcatcaacgcgcgggcgatagccacacgctgttgttgaccccccgaaagatgcagaggaaagcggtcagcaaaatcagttaaacgcaggcgtgacaataatttctgcgcacgggccatggcttcttcttttggcagacccagcacacggcaaggggcttcaaccagattttgtaccacggaaagatgcggccaaagattatattgctgaaagaccatgcccacgttagtacgcaactcgcgaatagccttttcacccggaacgcgggaaaaatcaaagtgattaccggcgatctgcaaggtacctgaacgcggcatctccagcaggttaagtacgcgcagcaacgagcttttacccgcaccacttgggcctagtaacaccagggtctcgcctgctggacaatctaatgtaatgtcgaacaacgcttgatgtgcgccgtagtaacagttaattccgttaagttgaatactcatgcgccaaatctgaatagccaatgatgcggggaatggtaacttccacggcatacttatgcaatctttgtgcgttaaaatttatgaatagccagaataaacggttaaaaacagcataacatttgtatttgattgcgctcagggggaatttgtcgcgtgatgaataaacctgccagagcagcaacatcagcagtgccgattaaaaaacagacagaaaaatgagtttgtaaatcaataagtaccgggccacgggaaggaacccggtacgaaagatgtgtggccgggaggactggcccgttattttaattttacctgattgaaggttgagaatatggcctcaacatcagcactggtgagattatgttggcgaatcgtgttgataaaatgcgccttatcacccatttcggcgggtttacaggttttcagttcctccgctatctgctcgaggatcttcgtacttaactcaccaatattagcgcgtacgtcatctagcggtttgggttgccaacccggttctggctgtgacagccagtccgcgcggtaacggtactggatagcttttgcggcattgatttgtgccaccataagcggtttgattgattcaccgtttaagcccagtgattccgcttgcgccatggcgctattgatcactttctcttcttgaatgcggtcttctataggtaaatgattttcagctttatatcccgcgacatctttcatatagcttaatcgctcattaatgagcggagccgtctggccgcattgctgtgcctgtacggccagggaaagaaaaaagctactggcgataattaatttaccgataacagttaaccttgttagcgtatgagtgggttgcatagtgatttcctccttgttgacaatgacggctcgtggggttgatagggaatggtcttggtatcatctcttcctatcaaagaggccagtatgttgaccactacggttgtctgtgggaagaggtgatagcggatgacgtgccgtgagccattccccgtggcgagccgttaggttagtgattacccaacaattggcgcaggctgctggcgggtgcgctaacgcccataaaacggatatcatcaacgacccagcatgttccttcacggatcatcagcacttcatcttgccacatcaccgccttgccatcagccatttggtggctcagattaacgcgtagcgggatattcctggcatcagtattggggattgtcgatgcgctggcaacactggcggaggtactgccttcacgtaagctggtgaaaatatcaccgctgatcatttgggttttattcacttgagccggtgtgcggttactggcttgttttctggcggcttgaatatcgttatacagcgactggcttaaataagggcgaaattgtgcggacagattatcatcaggtaggccctgttggccgccaatctgctggatacgcaagtcataaaatttttgcgctaccgtgtctggccctccctcaatacagggactactgcggctgctggtggcctcaaaaacaggattaacgttactggcacaggcactaagtaaaagagcgagagggaggatgagggcaatatttttctttttcatatgatgaccttaggtaaagtaatctgttatggcggctggcagataactgacgagttataagataaccgacgagttacaagataacctaataacccattagccgcgaaacttaccgtgttctttcagccagcgggcggtgcggagaataccttcatccagtgagatgattgggcgatagcccaactcttgctcggcacggagggtatccagtgtgagatcaaaattgagtttagccaccgcatagtgtgttaacaccggctctttttctgctttattgctcattttctccattgccctggccatgatatccatcatgggataaggcactgagcgaattcgacatttcatatccaacgcgtccagtagctgttgtacgatggtgcgcagagggcggggttgctggttggtaatattataagcgcggccagaaagggtcttttggctttgggtggcaagccacatcgcatgtacggcgttttccagataggtcatatccaccagtgcgtcaccgccacggggcagcagcagggtaccgtaatgtttaatcatatgtagcaagcggggcaacatcactttatcatgcgggccgaataacccctgtgggcgcagaatagtaaaatgtgtttgtggattggacagcgccagcagtttgatcacctcttcaccggcggctttactgcgagcgaattcattggcaaagcgcacgggccggaaatcttcctgaatattgcgatgatggtggtaatcgaaataaatggcgggtgaggagatatgaatgaaattctctacgccataagctgctgcccattctccaaggcgtcgcgtcgcgcgcacatttgccaacgcaaaagcctgctctgtcccccacggtgaggtaaagctcgagcaatgccacagcgtatcgacatccgccagcatggcttttgcctgtgaggaaaccagatccgtcaggtcagcatgaatgaatttagcccccagttttgtcaataacgcgcccatcgcctgattacgaccagtagcgataacactgatctcctgacgacggagatattcaaccgcatttcggcctaatccactggttgcgccggtaaccaataccttcataacgaattcgattcccacccaaaatcaaaatgctagcgcctgaaactattcgctgagcaaataagatgccattcttccgtgaaatgatgcgctatgcaatcattgctttgagcccgcgctattttttgcccgtgcatcacgttcacggtcatcgtgttctgccagcgcagtaatacgtcttgccattccgcgaaaaataaacagatgtgctggcatcatgacaaaccagtagagtaatccgctgaaacccgcgggatgccaccacgcgcggacatctaagctgcggcaaccgcccaagtctttaatcgtaaaggtcaggcggcctaaacccggtgctttcataccaaacatcaatgccaactggcgtaatggtttgacggtgatgactttccagccatcaatgagatcacccaattccaaggtttcccgttcagggcggccatacaccacaccaccgccgatcatatcgtccatcctggcacggattttccacaatgggttgccgtagaaatagccttctttgccaccgatttgttgcaccacatgccacaatgcctcactggacgcggttgttgagcgttggcaacctgcctgcttagggtaaaaaccgtaacctggccgccagcgtgcgcgggcctctgggtcataaccccagtcagcagagtcgacgacctcatcctcgcggcgcagtgtctctttgactgcatcctcaaaacggattaatttttgcgggatcagtgcctgtaaggcgcggccatcagccggtaaatcatggtttaggccttcgatcagtgcgctggcaattgaggttggcaccgaggtgatcatattaatgaaatagaccgagataaaccgggttggcagggggatcgggatcagccagcgacgtttgccgctgatggcaataaaccgctcaaacatcgtttggtagctgatatattctggcccggcgacatcccagattcggttttcttccgttggatgattgagtagctcggtcagataaaccaagagattatccagtgcgacgggtgacgatttagagcgtacccagcggggcggtgtcagaatgggcaggttataaaccatgtcgcgcatcacttcaaaggcagcagaaccggggccgacaataatgctggcgcgcaactcagtgaccgggataccgctttgacggaggatatcgcccgttaatttgcgggcgatcaggtgcgaagaactgttatctcccggctgtaatgcaccgagataaatgatctgtttaacggatgaggtttgcgctgttcccaatggctgtagggcgttcttcatattgctggcggctagacgttcctgttcaatcaaatcttggccgtcacccatgccatgtaccagataatacagtacatcaatatcttgcaacgcggcattgagggttgcgggctgataaagatcgacaaagcagcagttaacgtttggccacgcctgctctttcagccactcgatacggcggccagcagccgtgacttgatggccttgctggcttagcaaggggaccaaatgttggccaatatagccactggcacctaatactaatatccgttgtggtgtcatgaatgttgctcggcaataaattcacgccacagcgcgacgactttttccagatcttttcggctcacgttaaggtgagtaatcaggcgggtgagcggcccggcactgatcagcacaccacgttcacgcatccaggggccaagtttcaacgctgattcggcagattgcgtaatgtacagcacgtttgtttgcgcgccgggggcggctatctcaatgcctaagtcacgtaattgctgttccaaccactgggcgttatcgtgatcatctttgagtctcgccacattatgttgcagcgcatacaacccggctgccgctaaaataccggcctgacgcataccaccaccggtcatttttcgccagcgccgggcgcgatgaatgaattctgcgctgccacagagcagggaaccaacaggcgtccctaacccttttgacagacaaattgtcagggtatcgcaatactggctaatatcgttcagtggcacattcagcgccaccgcagcattaaaaacacgtgcgccatcaatatgtaacgccagttttttttcgcgggtcaacgcccaggcttgctgtaaataacgcaaaggcaagactttgccattgtgagtattttccaaacttaacagccgggtgggggcaaagtgaatgtcatcgggtttgatggcggccagaacgttatccagtggtagtgtgccgtcatcgttggcatcaataggttgtggttggatactgcccaaaacggcggcacccccggcttcatacaaatagttatgggctttttggccgacaatatactcttcaccacgctgacaatgggtcaatagcgccaccaaatttgcctgagtgcctgttggcagaaacagcgcggcttctttaccggataaactggcggctttggcttcaagcgcattgacggttgggtcatcgccatacacatcatcaccgacctcggcattcgccatcgcggcgcgcatggcggcacagggttgcgttactgtgtcactgcgtaaatcgatcagcatcgtcttctcattggctagaaaaatagatttcatcatagcgagaatatcgaaacaaaaaagcctactggctcgaggttattgacaaagtgcccgcgacggagagaacaggcagatcgtaaagacgccgtaaatacatccatgtaggctcgagccgcgccatcttgttttaaataggatctccccccaagctctggattaaattttagttcggtgtgatgtaaaaatgctgttttgccgagcaaagaatctgtcgccagtcgtgtcggtacatattcgatacgactggctggataaatgacaaagatctttattggctacaagacctctctagattgaaagaccttttgattagcgtaaccagttagtttttgccagctcgatcacttcatccccccggccattaataatggccctgagcatataaagactaaatcctttggcttgctcaaacttaatctgtggtggcattgagagctcttgtttcgccgtcacgacatccaccaatacggggccaggatgtgcaaaggcactttccagtgccgcatttaattcagaggctttttctacccgaatccctttgatgccggcagcgttggcaatggcggcgaagtctggattatgcaggtccgtaccatccgtcagatagccgcccgctttcatctccattgccacgaaccccagtacgctgttattaaataccacgatttttacgggtaattttagctgggtcagtgagaggaaatcccccattagcatggtgaaaccaccgtcgccgcacaaggccacgacttgtcggtcaggggcggttgcttgggcaccaattgcttgcggcatggcgttagccattgagccatggttaaacgaccccagtaaacggcgcttgccgttcatctgcaaataacgtgcggcccaaacggttggggtacccacatcgcaggtgaaaatcgcatcttctgtggcgtagtgactgatttgttgtgccagatattgtgggtggatcggttggttatcattcgcggtggcgagagcatccagatcttggcgggtggtacggtaatgttccagcgctttatccagaaacgcgcggtcacttttggcatctaactgcggcaacagcgcggtcagggtggttttgatatcgccaaccagcgccatgttgacggggcaatgagcgccaagacttccgggattaatatcaatctggatgatattggcgtgagtgggataaaacgcgcggtaagggaactgcgtccccagcagaatcagggtatcggcattgagcatcgcttgatagcctgaggagaaaccaatcagcccggtcataccgacactgtaagggttgtcccactcaatatgctcttttccacgcagggcgtgaaccaccggggcttgtagtctctcagccaatttgaccacttcatcatgagcatcagcgcagccgctaccgcacatcaacgtaatatttttagctttattcagggtgtcagccaagagcgttaactcactcatcggtggctgaactaatggtaatttaggtgtttgccagatgacggcggcatcttctggcgctgcctgtaacgcaacatcgcccggcagaacaataaccgatacgccacgattaagaatggcttggcgcatggcgatttctaacactcttggtaactgttctgggttcgaaacgagttcacagtagtggctacattcgcggaataactcctgtgggtgagtttcctgaaaataaccgctaccaatctcactggagggaatatgcgcagcaatggcgagtaccgggacatggttacggtgacaatcaaataagccattaatcaaatgcaggttaccggggccacaggaacccgcgcatacagctagctgcccggtgagctgtgcttccgccccggcggcgaaagcggccacttcttcgtgacgtgtgcccagccactcgatagttcccatgcgatgcaggctatcactcagaccattgagtgaatccccggttacgccccaaatccgcttaacgcctgcctgttccaacgttttagcgatcagtgttgccacagtttgcttcatagttgttacctcaaggtctattagcgaagttatgattctatgaggtcaaagtatggcgtgtttgaggataaatgccccattgatgatgcggataggcactttatggggcgggaaggtcggtcgtcgtcaggccaatggcgctatcacgccaattggacatccccctgaagttggcaactgcatgccagaacataaccttgcgctatttcttccggcgttagcgtcatggtgctggtggtggtgtatttgccatgcaaaatgtgggttttacatgagccacaaacacccgcgcggcaggcggccataaccggtattttatgttgttccagcgcaaagagcagggaggtgccaaccgggacgttgacactgcgtagcgggcggctgatagtcatcgtcaattcattactggtatcgataacctcatcagcggtacgaaattgctcttgctggaaatgatcggcaggcacttgctgttgttggcaatactgttcaacccacaccatatagggcgcaggcccgcaagtcatcacgcggcgatgagcaatgtcgggggcgacctgctgcataatacgggcattaattcgcccctcaataaaccccgccgttgccgctgactctgccatcagcgtgagttttaattgctgtggatagcgctgcaataaggtgtgccattcattggcaaaaatgacatcggcaggggtgcggacattaaaaattacccgaatatcggcctgtgggcgctgagccagtagtgcgcgacacattgatattacgggtgtgacgccacagcccgccgccagcatcagatagtggtcatcatcggcattggcgcaggtaaactcgccctgagcatcagaaagccacagataatccccgacattaacctgctgcgtcagccagcgggagccttcaccatcaggtaaacagcgcacggtgagttggataaaagggcttaaacccggtgtcgaggagagggtataggcgcgcaaggtttcatcactgttgcgaatactcaccaacgcgtattggcccggcaaataagagtaaaaatcgtgattaatcagccgtaggctccagacatcgggcgtctcttgcacgatggaatggacctgcatacggttagggcagaagggggtaggggaatcggttggaataaaatcggtcattggggcctcacaatgaatcaggtcattctctggcaaaagacgtcgcaaacagcgtgcaataatagcccggtcaacggcgagaaaggcgattgaccaggcaaggtataattaacttaatggcccaaaatcgcctgcatatcctgttctacggtggttattggctgcataccaaatttctcataaaggatcgccatcaggttgtcggtcaggaaacctggtgccgttgggccggtgtaaatattcttcacacccagcgacaatagcgtgagcagaatgacaatggctttttgctcaaaccatgacagcaccaaactgagaggcaggtcattgacggtgcaacccaatttttccgacaatttaaccgccaacatgatagcggcgtatgcgtcattacattggccgacgtccagtaagcgcggtaatccttccagagtgccgaagtccagtttattgaagcggtatttgccacaggctagcgtcataatgatgcaatcttgcggcacactgcgggcgaaatcggtgaaataactgcgctcagtacggctaccatcacatccccctaccaagaagacatggcgtagctttttactggcaaccaaatcaataacggtatcagcggcatttaggagtgtctggcggccaaaaccgacagtaatcaggtgttccagttcactgtaggggaagcccgccattccgagcgcttgctcaatcaccggggcgaaattctccccgtctaagtggttgacacctggccagccaacgatgctgcgagtccagatgcggtcaccgtagttgcccacattcggatcaataatacagttggaagtcatcaggatcggcccagggaacttggcgaattcggtctgctgattctgccagccgctgccgtagttccccaccaaatgtggataacgttttaactccggatagccgtgagcgggcaacatttcaccgtgagtgtaaatattaatgcctgtgccctgcgtctgctccagcaacatgtgtaaatctttcaggtcatggccggaaattaaaatcgctttgcctgctaccgggcggacattaacggacgtcggttgtggatcgccataggcctgggtttcgccctgatctaaaatggccatcacattgaagttcattttaccaatacccatggcgttattcagtaaggtatcgacatcacggggctgggtacccaaccaggccatataggcatggtactccgcataaatttgttcatcagactggcctaatacatgggcgtgttccatataagccgccgcgcctttcaagccgtataagcacagcatacgcaggccgtgaatatcatcgcccacatccgctttatcgttattgagggcgaactgctgtgattgttgcagcagagaagggatatcgtctgccaccagttgcaactcagccagtgggtgatcaacggtaattgtgctatccaacaggcggcaacggacagccagagagtggcgcagtaaaatggcgtctttggcgtattccacaatacggtcggaatcgaaattcacgttggtcagcgttgagaaaaatgctctgggggcaaagctgtcaatttggctatcgataatacccagttcacgggcttgtaacgcccaagccgatagcccctgtaatacagcaaccagcaagtcttgtagatctgaggtttcggcggtttttccacacattccctgcgcgtaagagcagccgttacctgctggcgttcggatagtttgttcacattgcacacagaacattgttattttcctttttaaagttgcatttgtaatgcgtgttttgagcatagagatacgccatcggtttaaaaaggtatttttaatgcaatattcacttatattgatttgacgcaattattactgcgaatgagaatttattcgatatagggaaggaaaagcccccagagggcggggggggggcgactgggagataggggagaattaggaaaagaaagccattaatatgggtgccagcaaactgagcaaaaagccatgtacgatagccgcagggaccatttccaacccaccactgcgctgcaatacgggcaaggtaaagtccattgaggttgcaccgcataagcccagtgcggtggagcggctactgcgcaccaatgttgggatcaacataattgccactaattctcgggcgaggtcattgaagaacgcggcgctaccaataacaggcccaaaggcatcggtcagtaaaataccagacagtgaataccagccaaaacctgaggccatcgccaacccggtttttatcggcaaaccgagcagcgcagcagcgataatgccgcccacgagcgcactcagcgcaaccacaaaggccactagggtcccccggcgatttaagactatctggcgcagcgtcataccgctgttacgcaattgaattccgaccaaaaatagcaggaaaatcagggctaattcactgcctttggccgcaaattgtagccattcccattggctcaggcctaacaggaaacccactatcacgacaccgcagagctttaatgactccagtgccatatgcaaccgtgaaggtaatatctcctgacgatgtgtatgtttccacggtattttacgttcgagtaaaaacagggcgagcaggttggcgcataaaatacacagaaaaaagaggctggtatattggaaaataagcagcagattagcgctaaggttctccaggaatgccaggctaatacccataaagaataaaatcacgtagaccatccagcttaacgagcggttgatccattgaataagtgttttgcggctaagtgggatgagataaccaataattaacggcaaaagaatgatcagcaatcctgaatacacgagtggtaccgtcctgtatggcgactaaaaatagactcttatgacttgaggttacagtggtgttagccgcgttcactcactcgaatcactgactgaattacgctcaccgtgatgttaccttgctgtggtaccaagaccaataatatgggcatcataaacggatgagcaatggctctgtaccacaataaactatataaaatcctagacagagtaaagtgctatgccatgcttgactaagacttgacctataaggtttttttacgcttttctcgcagaatgaaccgctattattattgggttaacaatgttatctctagtattcgtctgaatgagttctcatcggaggcgtagcatgtatcttgaacgcgtagaaattgtcggttttcgtggtattaatcgtatttcattgaaccttgacgataatacgttgctgatcggtgagaacgcttggggtaaatccagtttattagatgcgctgacactgcttttatcgccagaaccccaactttatcatttcactgtgcaggatttttattatccaacaggggatgaaagcgctaaagagcgtcatctacaggttattttgactttttgtgaaaaagatattggtcattggcatgctccacgttaccgccagctagccccactgtggataaaaaataacgatgggttacatcgtatctactatcgagtggaaggagagctgggtgatgatgggacggtatgcacgtggcgtacttttctgaatttagacgggcaacctctgccgttgcacgatatcgaaaaactggcgcggggagtgatccgtattcacccggtactacgattacgggatgcgcgttttatacgccgtttgcgccgtaccgtttccgaagacagtaaagcgccagataaggttgcattgaatcggcagttagatcagttgagccgcgagttggtacggaatccgcaaaaactgaccaatgcagagttgcgccaaggggtggaggcgatgcgccaactgcttgagcattattttgctgagcaaggttctcaattgccgggtcatcacaataatccccctcgtccgcaaccggaacgtgcggcgtggcaagcactagacaatatcaaccgcatggcggcagaacctaacagccgcagtatgaggctaattttgttggggatgttttcaacgttattgcaagcaaaaggctcactgagcctcgatcctcatgcccggccattgctcttggtcgaagacccggaaacgcggttacacccgattatgctctccgtcgcttgggggttgctcagccaattaccgctacagcgtatcaccaccactaactccggcgaattagtgtcattagtgccactggaaagcatttgtcgcttggtacgtgaatcttccagagtggccacttaccgtattggcccaagaggcatgagccctgaagacagccgtcgaattgcttttcacattcgcttcaaccggccctccgccttatttgcccgttgctggctgctggtggaaggtgaaacagaaatttggctgctgaacgaattagcccgccagtgcggttatcactttgaggctgaaggggtaaaagtgatcgagtttgcccaaagtggtttgcgcccgttgctgaaatttgccaaccggatggggatccagtggcataccttgaccgatggtgatgacgcaggtaaaaaatacgccgccacggtacgcaatatggccgatcaggggcgcgatagtgagcgggatcgcctaacaattttgcctgcacccgatatggagcattttttataccgcgcaggttttgatgaagtgtatcaccgtgtttcggcgatccccgcgaatgcgaaaatgcagccacgcagggtcattgataaagccatacaccgtacttccaaacccgatttagccattgaagtggccagccaggcagggcaatggggggtagaatcaatccccccactgttgaaaaagatgttctctcgcgtggtctggttggcccgaggccgggctgatgaatagagaggctaccatacctgtcatacttcaagccgcaggtggggtgactgagtttgtgactcggcctgtccatgggcctcgcctctgcggggccgccgcaagcagcgtttaaatcgctcacgtaattcgattaagctgctcacataaaatgtgcggctaaccccgcttctaattgctccagtagcacatagcgacgacgatattctgcccgctttttgctggcaatctcggtgagaggtttacggacaattttggtgggtaatctgaaatgcccttcagtgtctgggttaccaccgagtgagagccaaaagccatcgtaatcggcatgtaatttattttttttcttggcccgataacgccaattttgatagatatgagtggcgttccctaccgcgataatttcttctattcccattaattcagccagataacaggtcgcctctagcgccaaacgttttgggaataaaccatggcacgctttagtacaggcctgaatttcatggtgaggtgttttattatcagccccctgtaagccgccaataaataatgttttttgctgctgataataaaataaactgaaagtgagcaatgccagtgtttgttgttgctcattggccaacatcagcgtaatttcgccctctttattgagctttggtatgatgcccaaataaagggaatacttttcgccgcctttgccggttaatgttaccagcctataaggtgttcgatgtaaatagttgtaatgtaatgcttttggcatacattgagtgatgagctgaaagtgatcgcgcaagacatccagtttctggcggttattgaaggtgtggctcagataggggcgatgtaatttgcacggtaaatcgggttgtgcgcggagaaggctgtgtaagaaaggttgttttgacagtaagatcagaaagttaaatgttaatcttgggctgattaacgcccggatgataaatttaagccgaaacttccattcttgccatgaatcactgaatatcggactgcctttgcataacaatataatcagcccccaatgattgatattgtcagattttaattgtctatcactgatgactcgcatgattaaatccgtctaattactgtttttctagtggtattgaaacagttgagagctaaacaaaatatcaataaatctaatattttgtgccgtggtgcgatagagataggcgcttggtttagctaaatgagattttttgatggtattttctgcgggtatattttctttgtgttgatatgatccatttttcaaccacttaactgccatggaaataagaatgaagggaggtaattgatttgatgcaactcagtagaggtcagcgccggtggcttgccgccattgcggtattgcttatcggtggttttttcatcgccaggcatctgatggcaccggtacctgttaactatcaaacagtcaaagtggttcaccgtgatctgcaacaaaatgtcttggcaaccggtaagctcgatgcggttcgtaaagttgatgtaggtgcgcaggtcagtggtcagttggaaaaactgtatgtagaaattggcgatcacgttaagcgggggcagttgctggcgatgatcgatccacagcaggcgcaaaaccaaattaaggaagtggaagccacattacaggatttgaacgctcaacggatacaggcgaaggccgaattacacttggcaacggttacgctcggtcgtcaacaaaatttggctaaattacaggtggtgtcacggcaggatctggaccaggcagtaaccgatttggcggttaaaaatgcgaaagttggcacgattgatgctcaaatcaacaaagcgaaagccagcttagatacggccaaaatcaatctggattacactcaaatttctgcaccgatggatggtgatgttgtacaaatcaccacgttgcaaggtcagacggtaattgccgcacagcaagcgcccaatattctgaccctggccgatatgagtaccatgttggtacaagcacaggtatcagaagcggatgttatcaacctgaaaccggggatgaaagcctcgttcacggtacttggcgatcctggcaagcgtttttctggcgtactaaaagatattctgccaacgccagagaaagtcaatgacgccatcttttattcagcccgctttgaagtaccaaaccctgacagattattgcggttacaaatgacggctcaggtatccatacagctagcaaatgtagatcaggccgtggtgatcccactagctgcgctgggtgatgagttagggagtaatcgctatcaggttacggtcctgaaagagggcaaagaagagaagcgtgaggtgaccattggtattcgtaataatgtcgatgctcaagttattagcgggctgagtgtcggcgaagacgtcatcgtcagccgcggtggcacgggggatgcataatggcggcattgcttgaattagaaggcatccgccgtagttatcagtctggcgaagaaattgtcgatgtgttgcaggatgtctcattgaccatcaatgcgggtgaactggtcgcgattattggcgcttctggctcgggtaagtcgacattgatgaatatcttgggatgtttggataaacccagtgccggtatttatcgtgtcgctgggcagaatgttgatgagttggatgacgatgcgttggcggcactgcgccgtgaacattttggttttattttccagcgttatcacctgcttccgcatctcagtgccgcgcataatgtggaagtcccggcggtttatgcagggttgggtaaacatgagcgccgtgagcgagcaaacatgttgttgacccggctggggctgggggatcgtgtgagctatcagcctaaccagctttcaggtgggcaacaacaacgggtcagtattgccagggcgctgatgaatggcgggcaagttatcctcgccgatgagcctactggtgcgttggatagccattctagtgtcgaggtgatggctatcctgaaacaactgcaacaacaggggcatacggtcattattgtgactcatgaccccactgttgccgcgcaggctgagcgagttattgagatcaaagatggccgtattatggccgattcaggatcaaaaaatgagccagtcgtcgcggcggcagaactgatgagtttaacgccagcggcaccttcatggcagcaattggttggccgtttccgtgaggctctgttaatggcctggcgcgccatgtcggcgaataaaatgcgtaccgcgctgacgatgctaggtatcattattggtattgcgtcggtggtatcgatactggttgtcggtgatgccgcgaagcagcttgtcttggcggatattcgagctatcggtacgaacaccattgatatctatcccggtaaagattttggtgatgatgaccccagtacccgccaagcgttggtacatgacgatatggcggcattgaaagcgcaatcttacgtcagtgcggtatctccctctatcggcggcagtatgcggctgcgttttggcaatattgatgtggcagccagtgtcttgggagtcagtgacgagtactttcgggtcttcggtatggcgatggaacaaggggcacctatcacccgcgagcaggttgagcggcaggcccagacagtcgttattgacctcaatacccaacgccgcctgttccctcatatgaaggatgtggttgggcaagtgatattggtgggcaatatgcctgcgactgtggttggcgtggtagcagaaaaaaaatcgatgtttggcagcaataaagcactgcgggtgtgggtgccctacagtacgatggccaaccgcttgatggggcgctcttattttgattccatcacgatccggattaaagaggggtacagcagtaaagaggctgaacagcagttggtcaggttgttaaccttgcgtcacggtaaaaaagacatatttacttataatatggatagcctgttgcagacggctgaaaaaacaacgcagactatgcaattgtttctgacattggtggcggttatttcactggtggttggcggaataggcgtgatgaatattatgctggtttccgtaaccgagcggacgcgtgagatcggtatccgtatggcggtgggcgcgcgttccagcgacgttatgcaacaatttttgattgaggcggttctggtgtgcctgataggcggggcgctcggaatatcattatcctttgccatcgggctgattgtggaaatgttcttgcctaactggcgtattgctttcccccctatggcattgttcagtgcatttttatgttcgacggtaattggcgtggtgtttggctatttacctgcccgcagtgccgcacggcttaacccgattgacgcgttagctcgtgaatagtactgatttatgaatagcactgacttatgaatagcactggcttatgaagagcatgagtttgtggatagcattagctcgtaagtagaagataaacaagggttctctgttcgtactcttctgttagggtaatagaagtagataaaataaaaatgccagtcgtcattgactggcattttgaatcaaagtacaggtatgaatcacaatacgctgaattgcgatgaacagcgcagttaacgcaactcaaagatatctttggatatggctggcaggccacgtggtgtcaggccagtatagcgagttccggcggtgatacaccgtctaacggtggtacactatttaactctagcggaacaatcaggctagcatggttccctttggggccttcatgaacatcaaagttaactatttggccggcttttaatgttcggtaaccatccatctggatagttgaatagtgagcgaaaatgtcttcgccaccgccctcagggcaaataaagccaaaacctttggcgttgttgaaccatttaacagtacccgtctccatacttctacgtccctcgcaaggctattctagtttgagatgaggtaatcactggttaaagtgagcgcaagttggttaaaactccaacagctcacaaaaatacactctagtggaaatggccttaacgtcaagagaacggcttttgtctggcggaaggagttcttcaaagtttgatgtagctaacgctattgcgtttatttggttacaattttaccgttttcttgcgcaaacgccggcgtttttttctttggcggcgttatggcataagtgatgttaaaataatgatagatatctgtatgaaatggtcttataaccggagtgaggtattgctcctgtggggttcagtaaaacgatgggcaggcaatgggcaagaacaacgactggctgaattttgaacatttagtcaaagataaacaaatcgaggcgcttcaaccgccttcgatgtataaagtgatacttaacaacgacgattacacaccgatggaatttgtgattgacgttctgcaaaagttcttttcttatgatattgaacgtgcaacacagctgatgctcaatgtgcattatcaaggaaaggcgatttgtggtgtttttactgctgaagtggcagagacaaaagtcgcccatgtaaatcaatacgccagggagaacgagcatccactgctttgtacgctggaaaaagcctgattaaggcaattattgggaggtgcctatgctcaatcaagaacttgaactcagtcttaatatggctttcgccagagcgcgtgagcacagacacgagtttatgaccgtggagcacctgttgctggcattgctgagcaatccagccgcgcgggaagcgttggaggcctgtacggttgacctggtggcgttacgccaggaattagaagcgtttatcgaacaaactacaccgacactacctgtcagtgaggaagagcgtgatacccagccaacgctcagttttcagcgcgtactacaacgtgcggtctttcatgtgcagtcatcgggccgtaatgaggtttccggcgcgaacgtgttggtcgccatcttcagtgaacaagagtctcaggcggcctacctgttgcgtaagcatgatgtcagccgcttggatgtcgtgaactttatttcccatggtgcccgtaaggacgagcctagccagacgccgaatgtcgataactcgccaagtgaagagcaggccagcggggaagaccgtatggaaaacttcaccacaaacctaaatcaactggcccgtgttggcggcattgatccgcttattgggcgcgataaagagctggagcggaccattcaggtactgtgccgtcggcgtaaaaacaacccgctgctggtgggggaatccggtgttggtaaaactgccattgctgaggggctggcttggcgtattgtgcaaggtgatgttcctgacgtcatatccgaatgcacgctgtactcattggatatcggttcattgctggcgggtaccaaataccgtggtgactttgaaaaacggtttaaggcactgctaaagcagttggaaaacgacaaagacagcatcctgtttatcgatgaaatccacacaatcattggcgctggtgcggcttctggtggtcaggtggatgccgcgaatctgattaaacctctgctttccagtggcaagatccgggttattggttccacgacgtatcaggaattcagtaatatctttgagaaagatcgcgcgctggcacgtcgtttccagaaaattgatatcattgaaccaacaccagaagagacggttcaaattattaatggtctgaaacccaaatatgaagcgcaccacgatgtgcgttacaccgcgaaagcgatacgtgctgcggttgaattgtcggttaaatatattaatgaccgccatttgccagacaaagccattgatgtcattgatgaagcaggtgcgcgtagccgcctgatgccagtgaataaacgcaagaaaacggtcaatgtctcggatatcgaatcggtggtagcccgtattgcccgtatcccggagaaaacggtttctgccagtgaccgcgatgtcctacgaaatctgagtgatcgcctaaacatgttggtattcggtcaagataaggcgattgaggcgttatctgaagcgatcaaaatgagccgtgcggggttagggcatgagcgtcaacctgtcgggtccttcttgtttgctggccctacgggggtaggtaaaacagaagtgacggtgcagttggccaaagcgctcgatatcgaattgctccgctttgatatgtctgagtatatggagcgccatactgtcagccgcctgattggtgcgcccccagggtatgttggttacgatcagggcgggttattgactgattcagtgatcaaacatcctcatgctgtgttgttattggacgaaattgaaaaagcgcatcctgatgtgtttaatctgttattgcaggtgatggataacggaacactgactgataacaatgggcgtaaggccgatttccgtaacgtcattttggtgatgaccaccaacgccggtgtacgggaaacgcagcgcacttccattggttttaaacagcaggataacagcactgatgcgctggaagagatcaaaaaaatattcacaccggagttccgtaaccggttagataatattatttggttcaaccatttgtctcctgcggttatccagcaggtggtcgataaatttatcgttgagttgcaggcacaattagatgcgaaaggcgtgtcattggaggtcagtgatgaagcgcgcgattggttatctgagaagggctatgacaaagcgatgggtgctcgaccaatgacccgggtgattcaggagaatctgaagaaaccactggcgaatgaattgttatttggttctctggttgatggtggttcggttacggttaatctggataaagagaaacaacaactggcctatgaattccagagcgcgcaaaaacgtaaaactgaaggggcagttcattaagtcaacgggctagaaagcggcagccaacgacattggcgtggtaatcaggctgaaaccacgcctgcaacgtccatgtctgcaacatccatgtctgcaatatccagtaaaataaagggcgatagctaaaacagcgtatcgccctttttattgccaacgttaaacccccatcaggaggtggtgattgttttacgttcagcactgctttttacactcggtcgatcgctttttacactgtcgactgcttttcacattttgtcgaccgctcttcacattcagtcaatcgctcttcacgctcggttatttatcataaataaaagataacgcaaaacgcccttgccataaatgggaagggcgccggagggggactacatcctcagagctcgctagtcatcactaacgacagattagccgattaacggctacggaagacaatgcggcctttgctcaggtcgtacggggtcagctctacagtgactttgtcacccgtcaggatgcggatatagtttttacgcattttaccggagatatgagcggttaccacgtgcccgttttccaattcaacgcggaacatggtgttcggcagcgtatcaagaacggtgccctgcatttcaatattgtcttctttggccatcgaatcctctaggtgtaactaccttagtttttaaccggcaagataatgccgaaaaacccacattatgtaaagaagtgttggcgttcatctcaccatttcagcaaaattagtctgccggcaagagggggataaagcctaatgtggggtgttttgaacggttgatctttactgcatcgcggatgaaaaattcaacgattgcggtaaccagcattcagccggtagtggactaaactggagttgactcaactgctgcaaaaaaaagttgcgtgggatctcaaccgcacccagcgacgcagtgtgagcgttgaggacctgacagtcaatcagttctccaccatgttgggtaaaatgatgacaaaaaaccattaatgcactttttgaagcgttatccgccctactgaacatcgactcgccgcaaaataccgcgccaacagcaacaccatacaaaccaccaaccagctcattttccaaccaaacttccagtgaatgggcatgtcccaaagcgtgcaactggcagtaagcttgttgtacatcacggccaatccatgtcccttcatcacgttctgtggcacaggcgctaatcacatcagcaaaagcgtgattgagggtaaaacgataagggcaatgacgaataaagcgccgcatactccggctgatgtgtaaatcttctgggaataatacggctcggggatctggtgaccaccataaaatcatctccccagggttaaaccagggaaaaataccccgctggtaggccgccagtaggcgaggagcagttagatccccccctagtgccaataaaccgtttggttcgcgcagagccagctcaggtgagggaaaaataaatgactgtgatgagagctgtgtgacgcgcataaatctccttaatggcactgacaaatattgataacactggcacgctatctggacctcaataaccggcagtatcgcttggtttcagcagattccattttagtttcggcagcgtccattaatgttagctgccaattgacgtgatatttgcatctaccacagcatggttgccaatgcggctattttctttgttccactaatggcttcgttccgctgacggctcagtgccgctgatggaattggtaatagcgtcctttgttttgcaacaactggtggtgatcaccttgttcaacaattttaccgccatccattacacagatacggtccatatattccaagccgtacaagcggtgagtgaccataatcaggctcttatgctgacaatgttcacgtaacagcgccagaatctgttgttcagtctccgcatccagcccttcagtcggttcatcaagtaaccacaacggagccgagtgtaataatgcgcgggctatacccaaacggcgttgctcaccaccggatagtggccggccaccatcccccatccaggcatttaacccttcgctgttatccagcagattggttagccctacttgttccaagacttttttcagttgttcatcggaagcggtggggcaggccaataacagattttcacgcaatgtgctgctgaaaatatgcacacgctgactcaccaccgtcatcatctggcgcaacgccgcctcgtcatagcatgctagtggttgcccgttcagcatgatgtgaccctgattgacatcccaggcacgtgttaacaattgcaacagtgtggatttaccacaaccagtacggccaagtagcgcgatatgctctcctgcggccagtgacagcgatatattctgtaaaacgggtaacggctgctgtgggtaagtaaaactcagccctgtcacttccagcgccacctgtgaggttggtgctggaccgctgatagggaacgtcacttcaggcttttgctccattagctgacccactcgggttgctgaagcgatgacttgccccaaatgttggaacgcaccagcaacgggtagcagcgcttcaaacgaagctaaagacgtaaaaacaaacaaggccaaaaatgcaccaggctggttatcctcgccaattccccccgcagctaaccacataatcagtgtaaccgtaaggccggaggctaaaatcatcagtgcttgtgctaaacccgccagcgacgcctgttgtttctgacgcgccatccaatgttgttcaatttcttcaagtgaagcacgaaaacgctgtaatgcgccaaaaaccaagagttcagcttgcccttgtaaccaagaggtgagctgtgaacgataacgcgcacgcaagtccgtaaggtcactgccgataggcttgccagcgcgatagaaaatcaagggcaccaagaacaataagccgagcagtattcccccgagtgtcaatgccagattaagatccagatagctcaaaccaaaagtgactgcagcgataatcaccaaggccgctaccaacggtgatattacccggagatagaggtggtcgagggtatcgacatcagcaaccaagcggttcagcaactcactttgacgaaagcgcgcaataccggcaggtgagagaggcaagatcttctggaaggcaaatatccgcagatgcgtcagtacccggaacgtggcatcgtggctgacgacccgttcagcatagcggcctgcggtgcggataattgctgaacctcggacaccggcggcgggtaacaggtagttaaacgtatataaccccgctggccccgcaatagcggttccggcaagaaaccaacccgataacgtcaacaggccaatactggccagcaatgtcacaatagccaatacgataccaagagaaatcaagaaccaatgacggcgatacagcgccaaaaacggaagaagtacgcgcatgattaaagctcctcattgcgctgagacagcagattggcaaatgaaccagcagactggctaagggtggagtaatcaccttgttgaattagacggccattatccattacccagatttgatcataacccagggtgtcctccaactgatgagtgaccagcagggtagactgcgcacgggaggcctcctccagcgctttcatcaccaactgctcactgtgggcatcaaggctggcggtaggctcatccaacaacaataaacgacatgggtttaataatgctctggcgacggcaattcgttgagcttgcccaaccgaaagacgtgccgaatgatcgccaatttcagtattcagcccttgaggtaaatccttcaaaaattcattgatataagcccgctccaccgcctgttgcagttggtgctcacttgcatccggttgcctcagtaaaatattggtggccagcgtttgttccggtagatgtggattttggcctacccaacttaactgactacgccagacttggggttccagttcacgtaattcgataccgttaacttttagcgatccgcgataaggcaaaaaacccaacaagagattgagcaacgaacttttccccgcgccgctctgacccacaatggcaacccgtttgcctgctggcagtgagaaattaagtggcccggctaaacgggtaccattgggtgccaggatttccagctcattcgcctcaagggcgatggcctctttaccgtctagttgtttctcgccttgaccaatggcttctccctcgctgcttaaaaacgtcactaacgattcagccgcaccgacagcttgtgctttcgcgtgatagaacgtccctaagtctcgaaggggttggaagaattcaggcgccagtattagcaccaaaaaaccggcaaacagcgttacgccgaggccatagctaccaaaattcagttcccctaaataggaaaaaccaaaatagacggcaactacggcaatggagatggcggcaaaaaattccaatacagcagaagagaggaaggccatacgcagcacttccatggttcggctgcgaaaatcctccgaagagtcacggatttggtcggtttctgctttggcgcggttaaacaaacgtagcgtatccagcccacgcaagcggtcaaggaagttaccgctcaatcttgccaatgcgacaaaattacgccggttagcatctgcggcccccatcccgaccaatatcatgaatatggggatcaggggggcggtgacaaacaagatcaagcccgcggcccaattgatggggaagacagcaattaagatcaggaccgggataaatactgccagatacatttgtggtagatagcgtgagtagtactcctgcatatcttcaatttgttccagaattattgttgcccaactcccggcaggtttaccttttacccacgatggccccaactgttctagccggtctaacaccactttgcggatctgctggcgcacacgcataccacaaataaaccccacccgctcacgcagccaactgatcaccgcacgcaaggcaaatgcgcctgccagcagggagaactcggtggtcagtgtcgcacggggtaattcgtcgataatgagagattgcagcagggtggctaacaaccatgcctgagcgataatcaatagcccactaagcaggccgagtaacatggataggcggagccaacgttgcgcgggggcgctttgttttttcagccaacgaatcaactcatactgccttgtcttattcataagatgacttgtctgcacataaaagagtgatatcccctttgtacgctaagcggcgcttacttatcctaagcacatactggtatctgctcatcggggttcgtttgcttgcagcctactggcgactccaatgactctggggataaaaatatcaaaaatgtttgtcacccttgagtgagcaaaccagcgaggagtaatcttaccctgtcatgacccgaggtgaaaataattacgcttgtaaaaacaattgcatttgtgaaaaaaattgagtttgtgatggtcgccgcatgccaaaatgaaaataacggcttgattgttttttattggaatgtggatatccagcaacaaagcagataaaagcgggaaaacagataaaaaagcgggtggcccatgtagccacccgtatagaacgaggtgaaacggtgcgatcagtcgcaataaaaactcaatggaatagcgcgttatttatcgtttgccaacccgtccaggtagcgctctgcatccagtgctgccatacagccagtccccgcggaggtgatagcctgacgatagatatgatccatcacatcaccggcagcaaacacaccaggaattgaggtctgtgttgcattgccttggaggccagactgcactttgatatagccattttccaacgccagttggtcgctaaatataccggtgttagggctatggccgatagcgatgaacacacccgcaacggctaactcttcggtctcatcactgtgggttgatttcaggcgtacacccgttacccccatgtcatcacccagaacctcatccagagtacggtctgtgtgcagcacgatattgccgttcttcactttttccatcaggcggtcgatcaggatcttttctgagcggaacgtgtcacggcgatgaattaaatggacttcagcggcaatattcgccagatacagcgcctcttcaaccgccgtattcccaccaccgacaacggcaactttctggttacgatagaagaatccatcacaggttgcacaggcagaaaccccttttcctttaaaggcttcttctgacgccatccctaaataacgggcagaagcaccggtcgcgataatcagggcatcacaagtgtattctgcaccgtcgccaaacaggcggaatggacggttttgcagatcaacgctgctgatatggtcgaaaataatctctgtttggaatttttcagcatgctcgtgcatacgttccatcagtgctggcccggtcaaaccttccgggtcacctggccagttctctacctctgtggtggtggtcaactgcccgcccttttccatcccggtaatcaataccggtttcaggttggcacgtgcggcataaactgccgcggtgtaacccgcagggccagaacccaaaataatcaatttgctatgtttagccgtgctcatgaatacctctttcccacaatggcggataatatgaatgattgtagggaaaatatgacattaaaaaaagcaaacaaaaatgttgttagcaatttttttgataggtaaagcctatttattaaactaagtgtattaagaatcgacagttagcactatcgataattaaaaacattaatgcattaggtcaaaattccacctcaacgatcagactaaaaaaacctaaaatcgctttgaccccacaaaatatgtggcttgcagggcgataggcaacatttttactgaaatcctataagcttttttgtactattttttcgtcaaaaaaaagaagaaaaatcggtcagaggcggcgactgtgtggctaattctggcacgttctactgatttaacttcttttactttgacaatcggctgtgcatttgcgaaaacatcataggaagaagaaattatctgcgcgctatgatttcagattgggtatcagtgataccaagcgaaaaccctggaatgttttcgattaatactggatggcatgtggaataagttcatagacaacagtaggggggagtttctgctggtgtttatggtgtcttgtctcttcctcaacgctaataatcatcgagtggctcgcatacggttggacagacagggtgtgagataacaacgtgttgatctatttgcataaaacaggctgcgggtcgttgtttgtaacagactctggaatcttttacggctagaatctgttacagactcaaagaaattaagagagattatagatgatagataataagaaacgcccggggaaagagctcgatcgtattgatcgtaacatcctaaatgaattacaaaaggatggtcgtatctctaatgttgagctttcaaaacgagtagggttgtcaccaacaccatgtctggaacgggttcgccgcttagagcgtcagggcttcatccatggttataccgcattgcttaatccacagtatttggatgcatcattgctggtaatcgttgagattactctgaatcgtggcgctccggatgtatttgagcaatttaatgccgcagttaaaaatcttgaggaaattcaagagtgtcacttggtctcaggtgatttcgactacttgttgaaaacccgagtgcctgatatgtctgcctaccggacattacttggtgaaaccttgcttcgcctgccgggggttaatgacactcgcacttatgtcgttatggaagaagtgaagcagagtaaccgcttggttattaaaactcggtaaacgggcaggtgcaaaacctgagtaatttggttacactcctgtttattcatacagtttcaacgccggggaggcttctcggcgttgttgctcagacccgttaacaggaacctggagagcctttcttgagccaggaatatacagaagataaagaagttaccctaaaaaaactcagcaatggccgccgtttgcttgaagctgtgttgattgtggttactattttggctgcgtacctgatggttgcgctggtcagtttcaatccctcagaccctagctggtcccagactgcatggcatgagcctatccacaatttgggtgggagtatcggtgcctggatggctgacacgctgttttccacctttggtgttttagcctacgcaattccacccatcatggtgatattctgctggacggcttttcgccaacgtgatgctagcgagtatctcgattactttgccctttcattacggctgattggcaccctggccctgattttgacgtcgtgtgggctggcggcacttaatatcgatgacctttactactttgcctctggtggggtaattggtagcttattcagtaatgccatgttgccgtggtttaacggtgtcggtgcgaccttaacactactgtgtatttgggcggtgggattaacgctatttactggctggtcatggttggttattgccgagaaaattggtgcagcggtattaggttcactgacatttatcaccaaccgctcccgtcgtgaagagcgctatgatgatgaagacagctatcatgatgatgatcatgctgatggccgcgatatcaccgggcaagaaaagggcgtcgtttcaaacaagggtgtcgtttcaaacaatgcggtagtgggggcgggtgttgcggcctcatcggcgttagcccatggcgatgatgacgttttgttctcagccccttcggtgacggacagtattgttgagcatgggtcagtggttgcaactggtacagaagcaactgatacaaaagcaactgacaccaacgatgagtatgacccattattgagtccgttacgggctacggattatagcgttcaagacgcgacatcttcgccaatcgctgacgtagcggttgagccggttctcaatcatgatgcggcagcaacctatggtacgacaccggtaatgaccaatacggcaacaccgcctctgtattcttttgaactgccagaagagtcactgccaattcagacacatgctgcgccaactgaacggcctgaacctaagttgggtgcatgggatatgtcgccaacgccagtctctcattccccattcgatttctcggcgattcagcgccctgttggtcagttagatagtcgtcagccgggtagtaaccagtcaggtagtcatcagatacatagcgcccagagcagtcatatttcggtaggtaatacgccgtatatgaaccctggcttggatgcacagattgatggtttatccacaacgagcctgaccaataagccagtatcagcatctggtactgtggcagcagcgactgcggcggcggcttttatgcccgcgtttacggccaccagtgacagtagctcccaaataaaacaaggtattggccctgaattgccacggccaaatccggttcgtattccaacacggcgtgaattggcctccttcggcatcaagctgccttcgcagcgtatggcagagcaggaattacgtgaacgtgatggtgacgaaacacaaaaccctcagatggcggcatcttcttacggtactgaaataacatctgatgaagatgctgctttgcagcaggctatcttgcgcaaagcgtttgccgatcagcaatcagaacgttacgcgttatcaactttagcagaacagtcatctataacagaacggtcacctgcggcagaaatgccgaccacgccctcgcaggtgagcgatcttgaagatgagcaggctttgcaagaggcagaattacgtcaggcttttgccgcgcaacagcaacaccgttatggggctacgggggatacagataacgccgttgacaacatacgttcggttgatacgagtacggcttttaccttctcaccgattgctgatttagtcgatgacagcccgcgtgagcctctgttcacgctttctccttatgttgatgagacagatgttgatgagccagtgcagttagaagggaaagaagaatctctcctccaagattatcctgagcaagtgccaacttaccagccacccgtgcagcaggcacatttggggcaatccgcaccaactcagccaagccatacgcaatcaacatatggtcaatcaacatacgggcaatcaacatatggccaatcgacaccggcaccggtgtcacagcctgtagttacatcagccagtgttacatcagccagtgctatatcaaccagcgttacacccgctagcattgcgtcgctgaatgcagcaccggtgagcgcggcaccggtagcgccatctccgcaaccgccagcgttttcacagccgacagcggctatggatagtttgatccatcccttcctgatgcgtaatgaccagccgttgcaaaaaccgacaacaccattgcctacgcttgatttgctgtcttctccgcctgcggaagaagagccggtggatatgttcgctttagaacaaaccgctcggttggttgaggcccggttaggtgattatcgggttaaagctgaagtggtggggatttctccggggcctgtcattacccggtttgaactggatctagcacctggcgttaaagcgtcgcgaatttccaatttatcccgcgacttagcccgctctttatcggctatcgcggtacgtgtcgtggaggttatccctggtaaaccttacgtcggcttagagctacctaacaaacatcggcaaaccgtttacctgcgggaagttctggattgcgccaagttccgtgagaacccatcgccattagcgattgtgctaggtaaagatattgccgggcaacccgtggtggctgatttagctaaaatgcctcacttactggttgcaggtaccaccggctcgggtaaatctgttggggtgaatgcgatgatcctcagcatcttgtataaagctacgccagatgacgtgcgctttatcatgattgacccgaaaatgttggagctgtcagtgtatgaaggtattcctcatttgttaaccggggtagttaccgatatgaaggatgccgcaaatgcattgcgttggtgtgtcggtgagatggaacgccgctataaattgatgtctgctttaggtgtgcgtaatttggcaggctacaacgagcgagtggctcaagctgaggccatggggcgtccaatcccggatccgttctggaaaccctctgacagtatggatatctcaccaccaatgttggtaaaactgccatacatcgtggtgatggttgatgaatttgctgacctgatgatgacggtgggtaaaaaggtagaggagttgattgcccgtttggctcaaaaagcccgtgctgccggtatccatctggttttggcaacacagcgcccgtcagtggatgtgattactggtttgattaaagccaatattccaacgcgtattgcatttacggtatcgagtaaaattgactcgcgtaccatccttgatcaaggtggtgccgaatcactgctggggatgggagatatgctgtatatggcccctaactcctcaattccggtacgtgtccatggtgcgtttgtccgtgatcaggaagtgcatgctgtggtgaatgactggaaagcccgtggtcgtccgcaatatattgatagtatcctcagtggcggtgaagagggcgaaggcggtggccttggtctggacagcgatgaagagctggatccattgtttgatcaagccgtgaactttgtgctggaaaaacgccgggcctctatctcaggtgtacagcgccagttccgtatcggttataaccgggccgcgcgtattatcgagcagatggaagctcagcagattgtgagtacaccgggccataatggtaatcgtgaggttctggcaccaccaccccatgagtaatgggttacttcgcggtagtgctggcgagttctgttaatctctgagggggcgctttgcggcccttacgcaagttaaaggttcgaggttagtgtcccccctgcaacgtcaagccagtgggggaacgtattgatgaatcagcctttgtggcagcccagtaggggtgcaatgaaatttataaggtatttagaataatgaaaagactgcttgttgcttgctgttttctatcgggtttgatttcagcttctgcgttggcagatgccagcacagatctacaaaatcggttgagtaaagtgaatagcttccatgccagcttctcgcaagctgttaccagttcagacggggcggtagtgcaggaaggtgagggcgaactgtgggtaaaacgtcctaatttgtttaactggcatatgacatcaccggatgaaagcgtattaatctctgatggggaaactctgtggttttataacccatttgttgaacaagccaccgccacttggttgaagaatgcaacgggtaatacaccgtttatgttgattactcgcaacaacccagatgactggaagcaatataatgttaagcagaaaggcgatgattttgagctgacacctaaaagtgctagcggcaatttaaagcaatttgcgataagtgtgacgccaagcggcactatcaaaagctttactgctgttgagcaagatggtcaacgcagtgcttatacactgaaaagccagcaaagtagcgtggttgatgccagtaagtttacctttactcccccaaaaggtgtgacgctggatgatcagcggtagtgaggtctgagtgagtaatatgtccctcgatttttcccaaaatgagtttcaaccactggccgcgcgtatgcggcctttgacgttggatcaatatattggtcagcaacatttgctggcaccgggtaagccgctaccgcgggcaatcgttgccgggcagttacactccatgatcctctgggggccgccgggaaccggtaaaacaacattggcagaaattattggccgctacggtcaagccgatgttgagcggatttctgcggtgacctccggtattaaggagattcgcgaggctatcgagcgggcgcggcaaaaccgtgatgctggccggcggactatcttgtttgttgatgaagttcatcgtttcaataagagccagcaggatgcatttctaccccatattgaagatggcaccatcacttttattggtgctacaacagagaacccctcctttgaactaaattctgcattgctctcgcgagccagagtctatttgctcaaggcactaaccgcagcagatatcgagaaggtgattgaccaggcgatgtctgatagcagtcgaggttacggcgggcagaatattttactgcctgatgaaactcgccgcatgatgtctgagctcgtcggcggagatgctcggcgggcgttgaatagcctggaaatgatggctgacatggctgaaatagatgccagtggcgtccgtgtgttgacgccagaattgctgaaagaggtctctggtgagcgtagcgcccgttttgataacaaaggcgaccgttattacgatttgatctcggcggtacataaatctattcgtggttcggcaccggatgcggcgctgtactggtatgcacgcattatcaccgcggggggcgatccgctctatgttgcccggcgtttgttggctatcgcatcggaagatgttggtaacgccgatccacgtgcgatgcaggtggcgatatcggcctgggattgctttacccgtgtggggccagccgaaggggagcgggcgattgcccaggcaattgtttatttagcctgcgcgcctaaaagtaacgcggtgtatgctgcatttaaagccgcgatgcaggatgctcgcgataagcccgatttcgatgttccagagcatttgcgcaatgcgccgactaaactgatgaaagagatggggcttggcgctgagtatcgctatgcccatgatgagcagcacgcctatgctgcaggtgaaaattattttccacctgaaatggcggcgacccgctactatttgccaacatctcgtggtctggagggtaaaatcggtgagaagctggcatggttagctgaacaggataaaaatagcccgataaaacgctaccgctagctttgcggttgcggtaaggttagcattataactacttggtaagtggttgtttatatcgcttacgtcgttaaattcttctttaattaccatttatgcccttaatgattggcgttgcaggtaatcagccagcgaatcttgatgagcctacgaaggccaagtgattcgagtgagctggggctgctaataccgcagtaacgtcaagtcaaaagggtatatccataactacaagcacaggactagcatgctcgatcccaatatgctgcgcaatgagctagacgcagtcgccgaaaaactggctcgcagaggttttaaacttgatgttgaggtgttgcgccaacaagaagagcgccgcaaagttttacaggttgaaacagaaagtctgcaggcagaacgtaactcccgatcgaaacagatcggtgcagcaaaggcgcgtggcgaagatatcgaaccattacgtctggaagtgaatgctctgggtgaaaaactggatgccgctaaagctgagttggataagttacaaaacgaaatccgcgatttagcgctgtctatccctaatctgccagatgattcagtaccggtaggtaaaaacgagaatgacaatattgaagtcagtcggtggggcgagcctcgcaaatatgacttcgacgtaaaagatcatgtttctctgggcgaaatggccggtggccttgattttgctgccgctgtgaaactgaccggcgcacgctttgtggtgatgaaagggcaaattgcccgtatgcaccgtgctctgtctcagttcatgttagacctgcacaccgagaaacacggttatctggaagcttacgtcccttatctggttaatcatgccaccttgtacggtacgggtcagttacccaagtttggtgaagatctattccatactaaaccgttggcagaagaatcagataacagtaactatgctttgattcctactgctgaagttccgctgaccaacttggtgcgcgatgaaattttggaagaggattctctgccattgaagttgaccgcccatacaccatgcttccgttctgaagcaggttcctatggccgtgatacccgtggtttgatccggatgcatcaattcgacaaagttgaaatggtgcagatcactcgtccggaagattctatggccgcgctggaagagttgacagggcacgccgagaaagttctgcaattactggagttgccataccgcaaggtattgctgtgtacgggtgatatgggctttggctccagcaaaacttacgatctggaagtatggttgccagcacaggacacttaccgcgaaatatcctcatgttctaacatgtgggatttccaggcgcgccgtatgcaggcccgttatcgcaacaagaccgacagaaagacgcgtttagtgcacacgctgaacggctctggtttggcggttgggcgtaccttggtagcggtgttggaaaactatcaacaggcagatggtcgtatccaggtccctgacgtattacgtccatatatgggtggcttggaatatattggttaattggttaattggttaattggttaattggttaattggttaattggttaattggttaattggttaattggttaattggttaattgccgcgtctgttatctgctatttcgaaagcgtctacgggcgcttttctttttttgtgtatccccctcactgccagccataatgccccgcataaatactgaaatcatagctaaatgacatattgtgctatccctccccactgggtaattgacttttttatcgccagtggcatgatgcgctcacttttattgtcccgacggtttctgtcttactatgtccgcatattctcgccccgtgctactcctgctttgtgggcttttgctgttcacgatctctatcgcggttttaaatacactggttcccttatggttatcacatcaacagttgccgacttggcaagtggggatggtgagctcatcttatttcaccggtaatctggtaggaacgttgattgcaggccgctttattcagcaactcggttttaatcgcagttatcattgctcctgtatattgtttgcactggcaacttgtgggctgatgctaacggttgatttttggagctggttgggttggcgctttttggcgggcattgcctgcgcgctgatttgggtcattgtcgaaagtgctttattacgcagtggtaccttaaccaaccgcggacaactactggcggcctacatgatggtttactatttagggaccgtcatcgggcaattattattgggtatagtctccacacaactgctcagtgttattccttgggtgggggcgctggtgattacggcaatgctgccgctactatttgcccagttctcacatcaaagtcgtcacgagtcaccgcctattgcggtttggcctatgttaaaacgccgcagcgcccgtttaggtattaatggatgtattatctctggtgtactcttggggtcactctatgggttactgccactgtatttatcccataaggggatgagtgacgccagcgtgggggggtggatggcgttgctggtcagttcagggattattgggcaatggcctatgggaagaatggctgaccgctatggccgcttactggtactgcggatccaagtgtttgtcgtcatcctcggtagtgtggcgatcttgggtaattacgcaatggcgccggcgttattcattttaggctgcgcgggtttcactttgtatccggttgctatggcctgggcgtgtgaaaaagccagcgctgatgaattggtcgcgatgaatcaggcgttactgatgagttatacccttgggagcctggccgggccgacgatgacgtcactgctgatgcagcgctattcagataatttattatttatcatgatagcaggtgtcgcattcgtgtatttgatgatgctgttgagaaagccagatcaccaacaaacgccttatgctgcggtataaaagtaagccgtatcaatataaaacggtatcaatatataagacaacgccgccagcggattcatccagcatggcggcagttgttaggccaaacctaatacacatgagttaacagtacactttagccaataacatgcatcaatacagggttctaaatcagtagatgactttgtggccatagccttccaaaatacctttcacgcgatccataatctcttttgttggcggttttacgccatcaagcttgtattcttcccccatagcaatccatttgtgcttacccagttcgtggtaaggcagtaattctattttttcgatattactcatgttctgagtaaattcacccagcatatgtgctgatttatcatcgtcggaccagcctggcaccacgacatagcggatccaggttttctggttacgttttgccagataacgggcaaactctaaagtccggtgattggatacgccaaccaagttctggtgaatgctgtcatccatctgttttaaatctaacatcactaaatctgttgcatccaacaactcatcaatgacgggatcataccggcgtacaaagccattggtatccaaacaggtgtgaatgccttctttgtgacaggctcggaaccaatcgcggacaaactcagcctgcaatatggcctcgccaccagaggcagtgacaccgccacccgaagcattcataaagtggcgataggtgactgcttctttaactaattcttcaacggtcacttccttgccgccgtgggtgtcccaggtatctctgttgtgacaatacaggcagcgcattaggcagccttggaagaagacgataaacctaatacctgggccatcaacagtgccacaggattcgaatgaatgaatacgaccaagcacaggcttcttatcctctacgagatcggaggggtctgttgtaatacaatcggttatcttgttcataaagttccagttagtactgtttggtgctgaatggtaggcatgatatagacactcctttatgggactcagtacctgtgcattttacaagacgcgcagatacgtcatcatttggtgtattgcggagagccttaaaattttttctggtgtaataatattacctctatttactataaaaagcgttgcgtatatgagcctcagctcaggcatagcccagtaattaaggatttcgggtttcgctgacctctgtcttttatgctgttaattatagtttgacttaaacggtaagtctgtaattcgcagccttatcagatggaatcgttttagaggcaggaagcagactacgtcttccatttttgggtcttgataatcatcagtatattaccaaagtaatggccttatttcagataacttcaacccagagttcgttttcatttttcggcctaccgctgtctaaagagggaggctgttacatcagatgaaagataatgctatttctgattgggatttttgtgaccaatgagtctctcatcacgctattgattcgctataaataatgccattcattacaaatgaagccgttcgtataaaaaacaatgacctgatggataaatttttctgacagagccgtcggctagacgtgtgttacagcataaagcgtggggacctgcctattttcaagttaaaaacgtaaaatatattattaacttattgtaattattggtaattaagcatcttttaattgttaatgtaatgatgtgctgagagtatcttatacagtgctgttattgtaggcaaactacccctatgtgataatagacaggaaaagagtggagggatttagccttttttatcgtcacttttagtttttaacgttataaagtgagttttatacggaactatgagatgaaaatggagttttaccaatgaatgaaaattggaattggtctttagtagacaaagttgtttacattaatttgaaggaacgtacggatagaaatgagcacatcaaaaaagaactggaaaaagtgtgctttccacctgaaaaaataatccgctttgaggcaataagagcagggtcaggttttatcggttgcgcaaaatcacatcttgcagtattaaaaatggcgcaagagaataattggagaaatattttgatacttgaagacgatatggtcttcgaagatgatgatgaaacaattatccggacaaacaattttctctctaaactgaataatattcattgggatgctgcatttttatccgccagctattatatcgttaacgctattgatgataatttttttaaagtcaatttcgcctatctggctaacagctatctggtcaataatcattattatgaaaaattaatcaataactacacggagtctgttcagcgattaacaaatggcgagtcatcgtcagagtacgggttggattctaactggttgaaaataatgaaaatagacaactggtacggaatttacccggttattggctatcagcgtaccgatatcagtgatattgaatataaagagatcgatcgcacacaccagttcacccgaacattcgataagatgaaagcatacggttcaaaataatgatatttgaatttatcgtccactcagcaatatagcctgtatttcctactctgaatgaataaaggccccacaatatgtggagcctttcatgttgtaacaccttaccgcgtcaaaaagttagattgactgtgtaaaggtacgggtaatcacatcctgctgctgttctttggtcagcgcgttgaagcgaacagcataaccagatacacgaatggtcaactgcggatatttttccgggttctccatcgcgtctaacagcatctcacggttcattacgttcacgttcaggtgttgaccaccttcgatggacgcttcgtggtggaagtagccatccatcagaccggcgaggttagctttacggacttcatcgtctttacccagtgcgtttggcacgatagagaaggtgtaagagataccatctttagcgtaagcaaacggcagtttagccacggaagtcagagaggcaaccgcacctttttggtcacgaccgtgcattgggttggcacctgggccaaatggagcaccagcgcggcggccatctggggtgttacctgttttcttaccataaacaacgttagatgtgatggtcagtacggactgagttggaaccgcattgcggtaggtacgcagcttctgaattttcttcatgaagcgctcaaccagatcacaggcaatatcatcaacacgtgagtcgttgttaccaaactgtggatattcaccttcaatgttgaagtcaacagctaggccatcagcatcacggatagtggttactttggcatatttgatagcagacagggagtcagcggcaacagacagacctgcgataccacatgccatagtacggtaaacatcacggtcatgcagcgccatcagggcagcttcatagctgtacttgtcatgcatgtagtgaatgatgttcaacgcagtaatgtattgtttagccagccaatccataaagtgatccatgcgttccatgactttgtcatagtccagcacttcatccatcattggcgcttctttcggacccacctggatcttcattttttcgtcaacgccgccgttgattgcgtacaacatggttttagccaggttggcacgggcgccgaagaactgcatttgtttacccacaatcattgggctgacacaacatgcgatagcgtagtcatcgttgttgaagtcaggacgcatcaggtcatcgttttcatactgtacagatgaagtatcgatagacactttagcggcatattttttgaagttcagtggcagcttctcagaccacagaatggtcatgttcggctctggggatggccccatggtatacagggtattcaggaagcggaagctggttttagtgaccagagtacgcccatcaacgcccatacctgccaaagactcggttgcccagattgggtcaccagagaacagctcatcatattcaggcgtacgcaggaaacgaaccatacgcagtttcataaccaaatggtcaatcagttcctgcgcttcgatttcagtcagtttaccttctttcatatcacgttcgatgtacacatcgaggaaggtagaaacacgaccgaaggacattgctgcgccgttctgggatttaactgcagccaaatagccgaagtaagtccactgaactgcttcgcgggcgttagttgccggacctgaaatatcacagccgtatttagctgccatctctttgatttgagccagagcgcgatgctgttcagcaatttcttcgcgcaactggatagtcatttccaggtctttaccgttttctaaatcagcctgcagtgaattgaactgagccagtttgtctttcatcaggaagtcgataccgtataccgcaacgcgacggtaatcaccgatgatacgaccacggccatacgcatctggcaggccagtcagcacacccgatttacggcagttcaggatgtctttggtataaacgtcaaacacaccttggttatgtgttttacggtattcggtgaagacttttttcagttgtggatcaagctcacgaccataaactttacaagagccttcgaccattttgatgccgccgaatgggatcagagcacgtttcaatggcgcttcagtctgtaaaccaacgatagtttccagatctttattaatgtagcctgcatcgtgggagataatggttgatgctacgtcggtatcgaaatccactggcgcatgagtgcggttttccagtttgataccttccataacttgcgcccacagcttgtcggtcgcttcggtagagccggcaaggaaggattcatcaccttcataaggggtgtagtttttctggataaagtcacgaacgttgacttcattctgccaatcacccttggtaaaaccgtgccatgctttggccaatttctcattaagttcggtcataatgcatctaccttttaatgttaatttctcgaaaaccagacgtagcggccacacgttaatgttgctggtcaccgcgcagataaattacccaataagtcaaccctaccaatagtccgccaccaatgatgttgccgatggtgactgggatcaggttatcgataataaagttacttacggtcaagtgagcgaattgctcgggtgctgaaccgatggcttgccaaaactcaggtgaagcaaagtttttaatcacaatacccaacgggatcataaacatattggcgatgctatgctcaaaaccgctggcaacaaacattcccaccggtaaaatcatcgctaacattttgtctgttatggtacggccggagtaactcatccaaaccgccaggcaaaccatcaggttagccaaaatacctaagcacactgcctcaataaaagtatggtgcaatttgtgctctgctgtttgcagaacatttaaaccccattgaccatttgccacagtatattggcctgcaaaccagataaggccaacgaagaacagtgcgccgaacaagttcccaatatagacattaacccagttagttgccaattgacgccaggtgatacggccactggctttggcaaccgtggtaagcacagttgaagtgaaaagatcacccccacacaccacgactaacattagccctaaggagaaacaaataccaccgaccagtttggcaaaaccaaaaggaacgcctgcagtaccggtggttgctgtaatataaaaaacaaacgcaatggaaataaagacacccgcggtaatcgctaaataaaaagttgtcatcggatgcttggtggctttatagacaccagcatcttcagctactttagccattgccgaaggtaataatgcatcgaaggggttgtcagctttcacactaactctctcttatagggttaataaagcacagtgagatactagcaaagcagtatagcgtgaaaattgatatggatcatattgggcgagtttagtttagccttaaaccttgttttttatagggcttattggtctattgtattgattttaaactgaaaaaaatattttaatttttgcaaaaaattttgatttaacagcctgaacgttgtcgggaaagttaaagaaaagggatgtttgtagctgtttttatgggggctgttcattaaaaattaactatttatttacctctgtgtctttttttcctttttagaaaaaaataattgttcaaaaaggtcatttgggtgtcagaaaatagcgtttttttataacagaaacaatagtcagactcagatgagtgtatttctttttaataaggaataactgcaacaataaatagcgacagccaaaacgaaataaacaaggtgtggcgaaaatacgtactgacgttttagttttttttcatctggaataggggtttttatcgctgttggactgggtgttgccagcggattagcggtacttgtttacctgaatcacccttgtttacctgaatcactcttgcccgaatcactgacgcggggcagtgattcgggatacgcacgtttgtcgccaggctacaaactcaataacttggcggagcggtaaggaagagccgtattactcgcttttagcccaatggcgacgtttagccgcctgcaacttagcataagcgccgagtaaagcctgatgagcgggtaatgctttcagatcttcgtcaacactgaacaggccgttgaagcgaatttcacccgataaggccgctgaggcaatatcgaccgcttcctgaccatacatcttgacgaatgcattgtaatattgcatcgggtcacgatcaggctcttggttcaagagcagtagcgtttgcaggcaacggtaatagttggcctgttttgctgtaaagacggaagcgttaaagtcttgtgtccattcaacccagatcagcgcttgctcgagatcaccgcccgccagtgccagcattgatttcagttcgccaacccgcagggtgtaccagccattatctttaccggaggcgatacccagcagttcacgcacacgggcaaaatcatccaagccttcatcatcaatctgctgaatcaattccaagtactgtgctggctgccagtctgtatctggcaaggccagtaaagtatcacgcagatgtacacccatggtgttgttcgccatcagcaagtcttcggcagggtagatatcagacatccccggcaccaagatccggcaggcgtagacacctaagtgctcataatctgcgatgtacacttcggcaccttcttgttggaagatagccatcaatgtcgcgaactcttcttctgtggtgcccttgaagctccagtcaacaaatgggtaatctgcatcctgcttaaacatatcccaactaattagaccgcttgaatcgataaagtgggtttccaggttggtatgttctgccacttcttcgtcatcaaaggttggtgcagtaaagacatcaagatctttcagactgcggccctgtaataactccgtcaccgtgcgttctaatgccacaccaaaatcgggatgtgcgccgaatgacgcgaaacaggtaccgtttgacgggttaaatagcacgacacagataaccggataagcgccccccagagaggcgtcgtaagacaggatagggaaaccttcttcttccagcttagtgatagcttctaccacgcctggatagcgattcaatacctcggcggggatctctggcaagctgatggactccgcaataatgcggtttttcacataacgctcaaaaacttcagacagtgcctgtacgcgggcttcgttagcggtattccctgctgacataccgtttgaaacatacagattgccgataatattcatcgggatatagacagtttctaaatctgattgacgagtaaagggcagtgaacagataccacgcttggcattacccgactgcaaatcaaccaaatcactggcgaccaactcttgctctgggtcgtaaaacgccagcagacgctcatccagaatgccttccggtagcagattatccgccgggatcggaaaccacttctcgtttgggtaatgaacgaaatcaccctcagcgatggctttgcccagatagaagtcagcaaagaaatagttggtggataaacgctcaaaatattcgcccagagctgatgccagagccgcttttttgctggcgcctttgccgttggtaaagcacaacgggcagtcgcggtcgcggatatgtaccgaccaaacgtgaggaacagggttaagccaagaggcttcttcaatattaaaaccgaggtcgctcagtttttgctgaaaacgggagatagagtcttccagcgcagcgtctttgccgggaataaaagtttgcgtcattgtcttcactttttggcggtactaaaagcgggcaatcatacggggttttggttaatagctccatgtattctgaaagcacagtagatatcacagttttcatatggatattccggataattaattagcttataaataatggagtaattatatgaaatatataaagctaacggtactcgccggaatatttgtagggatcagtagcccggtttttgctctgcctaatatcactttattggcaaccgggggcaccatcgcagggggaggtgattctgctacaaaatccaattataccgccggtaaattgggggtagatgcgctggtagaggccgtcccggccataaaagacattgcgaatatccagggcgaacaagtggtgaatatcggctcacaagatatgaatgacgatgtttggctcacattggcgaaaaaaatcaataaagactgcacgaaaacagacggttttgtcatcactcatggaacggatactttagaagaaacggcttatttcctcgatttaaccgtcaattgtgataaacccgtggtgatagtcggcgcaatgcgcccggcaacggcattaggggccgacggcccgttgaacctctacaacgcggtggtggtcgccagtgaggcagactcggctaaacggggtgtgctggtggcgatgaatgacatggttttcactgggcgtgatgtggtaaaaaccaacaccacatcagtgcaaacattccaatcaccgaatacagggccattggggtatatctatgatggtaaagttaattatttgcatcaaccagcagcaagacaacccgcgtttgatatcagtaagctaaatacgttaccgaaagttggcattatttataactatgcaaatgcatcggacatacccgcaaaggcattgattgccgatggttatcaggggattgtcagtgctggcgtggggaacggtaatctctatcatacggttttcgatacgctggcaaccgccgcaagtcacggggttgcagttgtgcgctcgtctcgtgtgcccagtggttcaaccacagaaggtgctgaaattgatgacgctaaatacggctttgtcgctgcgggtgcacttaatccacagaaagcacgggttttattacagttagcattaacgcaaactcaaaaaccacaagaaattcaaaaattattccacacatattgatactgtgacttttttgcgaaggctacggtctttttatttctaaatgaatactacgtccatagggcgtggtattcatttagaaataaaaattcccgacagacatttattgcaaccccctctcctcatttttgcaatttattcgaagcagaacaatagatagaatgattttggttatatccgaaggggaaggctctctggataatattaatcaagatatggttgtaatggaatggacgccccattgattcggtatcaatgtatcaaaatataatggggtgaaaataatgcaaattctaatagcatttatggatattaaacatgtttacaaaacgtaatttcaaaaaatcggttgttatcatcacggcaattttttctgggtctgtgttcgcggatgtcaatattggtgatttaaatacgggggttattggcaatggaactgcggtagggaataataactcgcttggcggttcgacaaatggtgtcgttattggcaacggtggcagcttatccaactcgacaaatggcgttgtcattgggaatggcagtgttagtgatggggatggagtatcgataggtggcggcacgtcaacgaatggcggaattgcgattggtagcggctccaatgcaacacaatctgatgaaataaacatcggtgatcgccagataaccggtgttaaagcgggtgttgcagataccgatgcggcgaatgtcggtcaactggttgctaaagctggcgagacacttaatagcgctaatatatatgtggataaccaagcgaccgaaacacttaataatgcgaatctatacacagataacaaagcgactgaaacaattaataatgccaatacatacacggataacaaatcatccgaaacgctaaattcagcaaatagctatactgataataaatcatctgaaacattgaatagtgcaaatacttatactgacagcaaaactgctgagatatttaatacaaataaaacatacatggacgagaagtcgaaagaaacgctaaataacacctatgactatgtagatagtaaagtttcatcaattgtttatgatgtaaatagctatacagataagacggtaaatacagcgtttgaaacctcattatccgatgctaaaagttatgttgatgataaatacaatcaacttagtgataaagttaacaagaatttcaataagactaatgcaggtatttctggtgcaatggcgatgtcaggtattcctcaaaaattcggatatgaaaaatcgtttgggatggcgataggggcttatcgcgggcaaagtgcactcgctgtgggaggcgactggaacatcaatcataaaacgataacgcgagtcaatgtttctgccgacactgaaggcggtgtcggtgttgcagcgggttttgcttttggcattaattaatgaataaggaaattaaacggatgcaacggatgcaatgcatatatatcgccacttggttaatcgcagtatttatctcgccgatagcgatagctaacaatactaatattaatggcagtaccaataataacggtaatggtacaatcaatatttttgatgccagcagtaataacgatattcatacactaaccggtcttggtaatgagctgttgggaggatttagtaatcatcttatcgactctcataataatacgataaacgggggtcagagtaacaacctggtaagtagcgatggcaatacgatcagcgctattagcttgggcgatggcctcttctacggcgcgcagaataacacgttaataaactcaaacaacaacctacttattgtcactcagggcagtactataatagattctgatagtaatactgtgtctggcattagtaataatcttatagagagcaacagcaatattatcggtaatgaaaatagttgttattcggatcccgcgtccccatcaggagcgtggtgcgttgacaatcaaaatacgctcattggcagtgataacaatacgatcactggtgcgctgaatggtcttcacaacagtcataacaatgatattattgctagctctgtaaataatttaatggatacgcataataatattatcgcgggagggcactacaacaccattagtggtggtggaaacaatgacatttttgggagtgaaaacaatgttactgacagcaccgacgccaatatcaatggtagtaataactacgtgatagatgggaatggaattggtcgagatgatttgactgaagataactctatattgggcggctctggcaatatgggcgtgggggattcagtaaccgcgattaccaatagcgtggtgttcggcggtaatacatctggtaattcaaccggctccactctgatagattctgtatcggttagcggcaacggtacatcggggaataatgtcgttaatatcggcggagcggcaaacggtaataatagtgctagcttaggtacaggctcggtatcctctgaaggaggaattgcattgggtagcggttcgattgctacacggaatgatgaactgaatatcggtgatagacaaattaccagcgttaaaaaaggtgttgagaatacagatacaatcaatgttagtcagttaaacgatagctttgatgatgttctgaatttatcaaatgaatattctgacaactctttttccactgtcactgaaaatataaataattatactgatgcctcattagatactgtgttgaatacaactggtgaatataccgacaactcaatattattggttactaatgaaagcaataattatactgacaatggcatggagagtgttagtaattatgcaaatatctatgctgatgaatctttgttagctatatataatgaagaggctaattacatgtctaatcttatagatgtgacgttaaataatgctaataactatactgatctttcagttaataccattatatataccggaaaacaatatacagactctcgaatcaatgagtaccaacgtacttttaaaaatgaatttttaacctattctaatgggaaatttggcggttttgataaagatattaatcaaaagcagaaacaattaaacgcgggaatagcggcgacgatggctgctgcggttattcctcaaaaatcgggttctaaagtctctattggtgtcgggcttgcaggatatagcgatcaaggcgcaggatctgtgggagcgatttggcatgtaaatcaacgaatcacaatgaatacaacgatgacttacgatactcaacgtggtgttagtttattaacgggtttatctatcggcatatgatcgatacccgtcgtccttcaagatgtaggggtgagctgcccttattactcggcccgcccttgggcctcgcctctgcgaggccgctgcaagcagcgttcaaatctgctcccagcagatttgtcaccccagtcacttactggtagttgactttaaaataaataagctcatcgggattaatgagtctcatccctgaggctcaccctcggacagcataaatgctgttcaaatcggttccaacctatttgtctctcccttgcggcaacccgaattattttgggtataaccgttgcagcaggccgactcgaatgataaaaccggggtacgggttataacgatggcaatctcagtagagtgtggtgaggggaaatgacacaggtttataattttagcgctggtccagcaatgttaccggtcgaagtattacgtcgtgcagaacaagaattacgtaactggcatggtttgggaacgtcggtgatggaaattagtcaccgcagtaaagaatttatgcaggttgctgaagagtcggagaaagatctgcgtgacctgttgcagataccggctaattataaagtgttattttgccatggtggtgcccgagcacaatttgctgcggtgccattgaatttgcttggtgacagcaacagcgctgactatatcgatggtggctattgggcgcacagtgcggttaaagaagcacaaaaatactgcactcctcatgttattgatgtcaccacccatgacaatggcttgacaggtattcagccaatgaagcaatggaagttgagcgataatgctgcctatgtgcactattgcccaaatgaaaccattgacggcgttgcgattaatgaacaacctgatttcggcaataaagttgtcgttgccgattactcttcagccattctttcccgtcctatcgatattagccgttatggtgtgatctatgctggcgcacagaagaacattggcccagcgggcttgacactggttatcgtgcgtgaagatttacttgggaaagcccacacggcgttgccgtcgatcctagactacaaggtattggcagataacgattcgatgttcaatacaccgccaacgtttgcttggtatctttctggcctggtatttaaatggctgaaagagcagggcggtttgggcgaaatggaaaagcgtaatcaggcgaaagctgaattattgtacggtgccatcgaccgcacaggcttctatcgcaatcaggttgctattgctaaccgctcttggatgaatgtgccgttccaaatggcagaggcttcattagacaaactgttcttgagtgaagctgaagcacaaggtctgcaggccttaaaaggccaccgtgttgccgggggcatgcgagcttctatctataacgccatgccaattgaaggcgtaaaagccttaaccgactttatggctgactttgaacgccgccatggctgatttttctggggcggggactcatccgctccgctccggatcgatgggcctcttgcaacaatgagttcgtgtgtaataacgcgttaactcgtaataattcgtaataacacgttaatttgtaataacagcttcgttttgttcgaggctgttgcctatacaagactggagaatgtttttcccatgctggaatccctgaccttacaacccattgccctagttaatggcaccgttaatttacctggttcgaagagtgtctctaaccgcgcactgcttctggccgcgttggccgaagggaccactcagttgaataacgtgttagacagcgatgacatccgccacatgctcaatgcattacaggcattaggggtgaacttccgcctttctgctgatcgcacatgctgtgaggttgatggtctgggggggaaattagtggctgaacagccattgtcgcttttcttgggcaatgccggcaccgccatgcgtcctttggccgcggtgttatgtttgggtaatagcgatatcgtactgacgggtgagcctcggatgaaggagcggccaattggccatttggtggatgcgctacgtcagggcggtgcacagatcgattatctggaacaagaaaattacccgccattacgtttacgtggtggtttccgagggggggagttaactgttgatgggcgtgtctctagccagttcctgactgctttattgatgaccgccccgctggcggagcaagatacgactattcggattatgggtgatctggtttccaaaccttatatcgatattactctgcacttgatgaaagcatttggtattgacgtggggcatgagaactaccaaattttccacatcaaagggggccagacctaccgctcaccagggacttatttggttgagggcgatgcctcgtcggcttcctacttcttagcggctgcggctattaaggggggaacagtgcgtgtcactggtattggcaagaaaagtgtacagggcgacactaaatttgccgatgtgttggaaaaaatgggcgcgaaagtgacgtggggggatgattatatcgagtgcagtcgtggtgaattacagggcattgacatggatatgaaccacattcctgatgctgcaatgaccattgcgactacggcattatttgccacgggcccaacgacgatccgcaatatctacaactggcgggtaaaagaaactgaccggctgacggcgatggcaaccgagttgagaaaagtaggtgctgaagtggaagagggggaagattacatccgcgtggttccacccgtgcagctaactgctgcagatattggtacctacgatgaccaccgtatggcgatgtgtttctcgctggtcgcgttatcagacacccccgtgacgatccttgacccgaaatgtaccgcaaaaaccttccctgattattttgaacagtttgcgcgtctgagccaactggcctgatagcacctgaattgaatgggttctattacactaaaacgggcgcgaatcaagcgcctatttctataggatatctctctttattgttcatttttttttataaatggcgaggagtaagcgaatagatcgctatcgcaaatgtttttctggctatcctccctatcttttctacacttcaagctacaatctatggtcttattttcagcaactgaaccaactcagggtaacagttcataccgatgcagcgtataatgctacctctgtgtttgccctgccgggggcagacaagagatttgcctaccgaaaggagagataaatgacggcgatagccccggtgataaccgttgatggaccgagtggtgcgggtaaaggtacgctttgcaaagcattggctgaatcattgaactggcgcttgctggattctggtgcgatttaccgagtgctggcactcgctgctttgcatcatcaggtcgatatcagcaccgaagaggcattggtaccacttgccgcacatctcgatgttcgttttgtttcacagaatgggcagctacaagttattttagaaggcgaggatgtcagcaatgagatccgaaccgagacagtgggtaatactgcatcccaagcggcggctttcccccgtgtacgtgaagcattactgcgtcgccagcgagcttttcgcgaagcgcctggtttaattgctgatggccgggatatggggactatcgtgtttcctgatgcacctgtgaaaatatttcttgatgccagttcgcaagaacgcgcgcacagacgtatgctacagttgcaggaaagagggtttaatgttaactttgaacgtcttttggccgagatacaggagcgggataaccgtgatcgtaaccggtctgttgcacctttagtccctgcggcggatgcgttggtactggattcaaccagtatgtccatcgaacaggtgatcgaacaggcgctggcttatgcccaacgaattttagccttgccgttgaaaaaataacgacaatgcggtcagttctgcgctctcaatacgatttttttaaaaattattaaaattaatattgaagagcactttaaccttgttgcaaggatgtgtggcgaggcatgtgaaacaaccccatccggcgggatgctagatggacgttaaacttaagaatcctgaagattattaacatgatagaatcttttgctcaactctttgaagaatccctgaaaacaattgaaacacgtccgggctctatcgtccgtggtgttgttgtttctatcgataaagatatcgtactggttgacgctggtctgaaatctgagtcagcaattccagcagaacagttcaagaacgcgcaaggcgaactggaaattcaagttggtgacgaagttgatgttgctctggacgctgttgaagacggcttcggtgaaactctgctgtcccgtgagaaagctaagcgtcacgaagcatggctgatgctggaaaaagcttacgaagaagctgcaaccgttactggtgtgatcaacggcaaagtgaagggcggctttacagtcgaactgaacggtatccgtgcgttcctgcctggttcactggttgatgtgcgtccagttcgcgatactctgcatctggaaggcaaagagcttgagttcaaagtcatcaagctggatcagaaacgcaacaacgtcgttgtttctcgtcgtgcagttatcgaatccgagaacagcgctgagcgtgatcaactgctggaaaacctgcaagaaggcatggaagtcaagggtatcgttaagaacctgactgactacggtgcattcgttgacctgggtggcgttgatggcttgctgcacatcactgacatggcttggaaacgtgttaaacacccaagcgaaatcgtcaatgtgggcgacgaaatcactgttaaagttctgaaattcgaccgcgaacgtactcgtgtatcccttggcttgaaacaactgggcgaagatccatgggttgctatcgctaaacgttacccagaaagcactaagctgactggtcgtgtgactaacctgactgattacggttgcttcgtagaaatcgaagaaggcgttgaaggtttggtacacgtttcagaaatggattggaccaacaaaaacattcacccgtctaaagttgttaacgttggcgacgtagtggaagttatggttctggacatcgatgaagaacgtcgtcgtatttctctgggcctgaaacagtgcaaatctaacccatggcagctgtttgcagaaacccacaacaaaaacgaccgcgttgaaggtaaaatcaagtctatcactgacttcggtatcttcatcggcttggacggcggcatcgacggcctggttcacctgtctgatatctcctggaacgttgcaggcgaagaagcagttcgtgaatacaagaaaggcgacgaaatcgcagctgtggttctgcaggttgacgcagaacgtgagcgtatctccttaggcgtgaaacaactggcagaagacccgttcaataactacctgtctgttaacaagaaaggtgctattgttactggtaaagtaactgcagttgacgctaaaggtgctacagttgaattggctggcggcgtagaaggttatctgcgtgcttccgaagcaactcgtgaccgcgttgaagatgcgacgctggttctgaacgtaggtgatgaagttgaagccaaatatactggcgttgaccgtaaaaaccgcgtaatcagcctgtctgttcgtgctaaagacgaagctgatgagaaagatgctattgctacggttaacaccaagccagaagaaagtaatttctctagcgcaatggctgaagcgttcaaagctgcgaaaggcgagtaataacggggggcggttcttccgccccaatacggtagtttagctgaaaagcttggaggtaatatgaccaagtctgaacttattgaaagacttgctggccagcaatctcacgtgcctgctaaggtcgttgaggatgcagtgaaagaaatgcttgagcatatggctggaacactagctgaaggtgagcgcattgagatccgcggatttggcagtttttctcttcactaccgtgctccgcgtgttggccgtaatccaaaaaccggtgataaagttgaactggaaggtaagtatgttccacactttaagccaggtaaagaattgcgagatcgcgctaatatctacggctaagttgttcacaacttaccgcgttattatgtaaacgctgatacgaaacggtgcccttatcggcatcgttttttttgcgtaaaaagtcaatgatatatctgtaaaaatgaattccttgaatagcgtgtttatcacatagttttatagaccgccggttatcctccctatcgtcactcttactctcttttctctgtgtttcttttctctgtgttgttccacaagcacttctttgtatgcatccatccataaacatccacccataaacatgcgtccataaacatgcgtcctacatgttttttgactaatacacactgtctacactctgggattcaacatgtttctggtttcgatacatcccgcatttttttggcggatcctgcaacaagttaaaataactaacgagccagtgctgaaattatactttttgccctagcgtctttggccccaatgttgagaatcaacctattccaaatggcgtaaacagccagacgacagagatgaatagcaatgaggctattcaagagtaaaaacagggatggtttttatcgcgttatcaacagatcgggtcgccgctgctgtcattgtcgggatcttgcctcttatttttctgcatcaactaccagggcccactatcattggttctctattagccctaagtgcatttttgtggttaagccgcaatcgttactgccaatttttagcgctgattgtgattagcttcctgtggggggtttggcatagcaatgggatactgatgcaaacagaagcattaacccagggggatcagcagatagttgcgacaataaacagttcatctctttcatgggatgacggccagaaagttgtgataagtattcagaaaattaatgaaaaacgggttttccctccaatagcagtcaacgttaagtggccagaacggttggatcaatactgtgcagggcaacgctgggcgtttaggttacgtatgagggcagtacatagcgtactgaatgagggcgggtttgacagtcagcgctgggctattgctaacagacgtccactacaagggcgcatcattgaggctaaattactggatgcagagtgtaattttcgtcagcaaattatcagtagcatagagcagcaactggtgggatatgatcagcggcggatcatgctagcactggcctttggtgaaagatcacaactgaacaaagaagagtggtcactcttacgctacaccggcactgcgcacctgatggcgatttccggtttacatattgcactggcggccttatttggtgggatgcttgcccgattagtacagctcctttttcctgtcagttggattgggcctttgctaccgctactgattggctggctgattgctatgatttatgtctggctggcaggagcaaactcaccagcaatccgggcggccattgcgttaacgctgtggctgctgctacgtttgttcggtattttatgtagcccatggcaggtgtggaggtgggctttggggctaattttagtcagcgacccgctagccgtattatcagacagcttttggctctcctgcctggcggtatttagcctgatatgttggtttcacttggcccctgtttcttctcgtttcattactggttggtatggcttggttatccgttggtttcatttgcagtttggtatgatgctactgctgatgccgttacagatagggttattccacggtataagtttattttctatacccgccaatctgtgggcggtcccaatagtctcattgttcaccgtaccctgcgtattattagcattggctttagcattgctccctgctgttgctgatatattttggttcttggctgatatctcgttgactgtggtgctattcccgctcaatcagctaaaagaaggctggttacacactggcatggcttctgttgcgatcggttatggtggttggctggcattatttatctggcgctttcaatggtggcgcagtcatcctcttggtgtcattgtgctgtgtatgaacatggtattactgactcaacggcgtgatgagtatcactggcgtgtggatatgctggatatcgggcatggtctggctgtggtgattgagcgtgaggggaaagccattatctatgacactggtaatcattggcctacaggtaatatggccgctattgtcgttttaccgctccttaaatggcgtggcattactgttgaacagattatccttagccatgaccatcaggaccatactggcggtttggctgtactcttggatgcttttccgcaggcaacggtacgtgcgcctttctctgtaaaaaacgtagccaatactctgccttgtaaacagggggagagatggcagtggcaaggtttagattttgacgtgttatggccgaaagaacaggtggttaatgctcagaataatgactcatgtgtcattcgcattaatgatggtaaacatagtgtattgttgaccggggatcttgagtcccaaggagaacggcagttggtgaacgatatccggggagaattaacatcaacggtgctgcaagtgccccatcacggcagtaatacttcttcaaccgcgccttttctacgggcagttagcccagaattggccctcgcttctgttgctcgttataaccaatggcgactacctgcgaaaaaagtgatcaatcgctatcaaaaaaatggcattatttggcgtgatacatcagtatcagggcaattaagtgtatattttcactgcgatacttggttcgttaaaggctatcgggaacaattaaaaccacgttggtatcaccagcggtttggcgttagaggtcataatgagtagaatgggccgctatttcttatggtgttggtatttgcatgatgaatgataaagatctatccacttggcagacctttcgtcgcctatggccgacgatctccccttataaggccggtcttatcgttgcggcgatagcattaatccttaatgcggccagtgatacttttatgctgtcgttactgaaacccttgctagacgatgggtttggcaattcgaacagttcaattctgaaatggatgcctttggctgttatcggcctaatggtagtgcgtggcgtgactggttttgtctcaagctactgtatttcttgggtgtcgggtaaagttgtaatgcatatccgccgccgcttattcagccatatgatgggtatgcctgtttctttctttgaccaacaatcgacgggtaccttattgtcgcgcattacttacgactctgagcaggtagctgcgtcctcctccagtgcgttggtgactgtggtgcgggaaggggcctctatcattggtttgttcattatgatgttttattacagttggcagttgtcgctgattttaatcgtcattgcacccattgtgtctatttcgatccgtctggtatccaaacgttttcgtaatatcagtaagaatatgcaaaatactatgggggaagtgaccaccagcgctgagcaaatgctcaaagggcataaagaagttttgatctttggtggccagaaggttgaaaccgagcgctttgatgctgtcagtaaccgtatgcgccagcaggggatgaaactggtttctgcctcttctatttcagatcccatcattcaattgattgcctcttttgcattggcacttgtactttatgcggcaagttttccaagtgtaatggaaacgttgactgccggtactatcaccgttgtattctctgcgatgattgctctgatgcgtccattgaagtcgctgacaaatgttaatacccagttccaacgcggtatggcagcctgtcagacgttattcagcatattggatatggagcaggagaaagacgaaggcaagcttgaagttgaacgggcgaaaggtgatatagaattccgccatgtgactttctattatcccggtaaggatacgcctgcgctaaatgatatcaatatacaccttgaagcgggcaagaccgtggcattggttgggcgctcaggttcaggtaaatccaccattgctaacttactgacccgtttctacgatgtcagtgaagggagcattttgttagatgggcatgatctgagagattaccggttaggtgccttacgtaatcaagtggcgttggtttcacaaaatgttcacttattcaacgatactgtcgctaataatattgcttacgcccgtaatgaacagtacagccgtgctgaaattgaagaagccgctcgaatggcgtatgccatggactttatcaataagatggaacacggtttggataccgttattggcgagaacggtatcatgctctccggtggtcaacgtcagcgtatcgctatcgcgcgtgctttactacggaactgcccgatattgattttggatgaagcgacttcggcgctggatacagaatcagagcgagctattcaggccgctttagatgagttacaaaaaaaccgaacttctctggtgatcgcccatcgcttatccactatcgagaaagcagatgagatcgtggtcattgaagacgggcgtattgtggagcgtggtgtacacgctgaattgctggtccagcaaggtgtctatgcgcagctcaaccgtatgcagtttggccaatgattgagcgtatctggtctggtcaatcgcggctgtatttactgctgctgccgttgtcctggttatatggtgctgtcacttggttgatccgagccagttatcgcttggggctgcgttcggcatggcgttcgccggttcctgtgatcattgtggggaatcttactgcgggggggaacggtaaaacaccggtggtgatctggttggttgaacagctacaacagcgtggctatcgtgtgggtgtcgtgtctcgtggctacggcggtaaatcagcggtctacccgctactgctgtcggataacaccaccactgctcaggcgggtgatgaaccggttcttatctttcagcggacgggggcaccggttgcggtgtcacccaaacgggcagacgctatcaaagccttactgcaatctcatgcggtagatttcatcattactgatgacggcttacaacattatgcgctacagcgtgattttgagttggtcgtcattgatggcgtccgccgctttgggaatggctggtggttgccagccggccctatgcgggagcgggagggcagattgcggtcagtagatgcggcaatcaccaacggtggcctcgctgctgagggggagatccccatgcaactggttgcgcgggaggccgtcaatttggttacggggcagcgccaacctgcggaacagctacagcatgtcgttgctatggccggaattggtcatcctcctcgcttttttgccacgctaaatttgttaggaattaaacctgaaaatgagcatgcttttgctgaccatcaggattattcattggcacaattaagccggttgacttccggccctcaaattttattgatgacagaaaaggatgccgttaagtgccgggcttttgctctgccgaattggtggtacttacctgtcgatgcgcaactaccgtccgatagggcagataaactattgttaaatattcaggcgctatctcctgatactaagtagctcccttttattggcttaacaacgttagtttgagggcggctgcacattcagcaacggaacgttgctgggttgcttcgtagagttgcagttcatcaataaccgcaatccccaaatcccgctggaagtctgctttattggagtgcccggtaaagtgactctgccctttctcgcctaagtttgactggaatattccagcggcgctgactggcaggaaatcttcataaaccaacggttcatattgaataaagccgttatcaataagttcgtctaatgtcatttcctgtatttcctgtatttcctgtatttcctgtatttcctgtatttcctgtattgatgcagtgataaggcctttttctgtaggaaaatagcggaagaaggcgagtttctctgctcgcattgttgggtaatcatcagggaattgactaaatttctcgctcaggatcgcgctatattgcgccgcattgttctcatttacaggaacgttcaattgatcctgtgcgctttgcagtaagtggtcatacagattacggcctttggccgtcaaagcggctcctcgttgctctatctccccgaagcgggccgtatggtggcctggtattatttgcccaccatttgatacaaacgcgattttttcctccagcgccttgaagctggtttggcgtaacagtattgggcagtggcgggggggtggcccttcgataacggctttgggcatcatattatgctctgccattgctgtttgtacgacgtcgatatttaaggtccgtggagttaggtggttaatatgcggacctttgaaagcgaccacatcagcaatcagacggtgttgatcgtgtagctgttggtaggtttcagtgctgaccgttgcctgatgatgccagcgaaatgtttccagcgactgagcaatgaaatcatcggcttgatggcgattgagcccccccgatgtttcatgctgaacaattagtttaatcgcctgtggggtgaaaattgttcttttcgccagaatatccgcagccagttgccgtagtgtaggttgctcaatcaactccagacgcagtaatgaggtgaagactctgaaagggcaggcttgcagtgaggtttcatgcaccgcacggaaggcggtggagtgaaccgggacacccgctggtgctaaatcataataaccgaccggcaccattcccatgactgcaaacaagcgccgcagcatcttgagttcttcggctgtcccgacgcggatggcgccatgtctttccatcgttaggcgttcaatttccccagtttgctgcaaatgacgggtaagcttctgatcttgcatcatctcttgtgtattcgtgtccgcaacgagccgtaataatgtgctatatagggggacttcggtctgatacatatccgacatagcgctggagaatttggcccgtatctcatcgggatgcacaaactgttggggggtcataatcggataactccttcaggcgctttcagtgtagacaggttttcatgtagacaattttcaatgtaggccatcatggttgcggatcacgctgatacagtttcattttaggtcgagttcggtgaatcaggttgcagtcagtggagaatattgattttttatgcgtcacatctcattgatactcgatgttattgcatattgcgagataaaacagttgcatagtcgggggttttatgtgtaaatagctgcggcctattatttaggcctatatatgtataaagcgtatttatgtgtagggtgtgtgcgagagtaaagcagttcctccccaagcgttatcttttgatatcgcgtcaaagacgaacctcctaaaatcttcgataagcaattcccataagtccataagtaatgtttctgatgcagaatcgctattgctaatagcatcgaatgcctgcggtagattggctatttgtatccgaaaatacataatttgttgttctgtgattcagaataataatgtttaggctatctcaggaaataaaatgattatgcaagcgtgctaatcattcaccaagatagacaaaattacaaaacccgcaattatgcggttttttcataaaatcaagctcatagaggtttagtcaaaaaactttaggatgggcaactgcatctaaacaataaataataatgagttgttaggatgcccagtaaaaggaaatttattatgacgttaaaaatggggcgcgtgaagtggttcaaccagtcggaaggctacggtttcatttcaccacacgatggtggttcggatgtttatgtcaacaaaacggccattgccaacaccaaaaacaaatcactgaatgaagggcaggacgttgagttttctacatatcgtagtattcacggaccgtcagcagcagatgtgatcgctttctaagcaaacggctacctcatcggtagccgtttctcccttctcgtcagcgccataacgtcgttagcggctcttactcacctgaatcactgacggatgtgacctcatcggggttcgcttgattgctatctggctgcaacgctaatgattttgggtagtcggccgctattcaacagatttctcatctcagtgggccgctgtgcaggtgctttctatttgtaatgatatttcgatatgtaatcttgtggcttagttactgaagttagcaaacagcgcaataatcttatgtaatgttttcatttttgattcaaaatgctcatttatgtgactttaatcacaaaattctactccccattattcaacatatcaataacaaaaccaacaatcatttatctaatagctgacaatatgggctaatacggcggctgatgatgcatcattctgggttatcgatggctgtagggaatcaccacatcggcatagttaacctgtatgagcggatatggtatcctcaaacactttcctgctggctaaactccattttggaggatgtatggaccaccgtttactcgaaattgttgcctgcccagtctgcaacggcaaattatactttaataaagaaaaccttgagttggtgtgtaaggtggataatctggcttacccggtacgcgacggtatccctgtcttgttggaaaacgaggcccgtccactgtcaattgatgagaagcacgcatgagtttcattgctataattcccgcccgctatgcttcaacccgtttacccggcaaaccactggctgatattgcgggcaaaccaatggtcgtccatgttatggagcgggccttggcgtcaggtgctgatcgggtgattgtggcaacagaccatccagatgtggtcaaggcggttgaggccgcaggtggtgaagtgtgcctgacccgtgctgatcatcagtctggcactgaacggttagccgaagttattgaacactatggttttgctgatgacgatattatcgtcaatgttcagggcgatgaacccctggtgccgccggtgattatccgtcaggttgctgataatttggctgcatgtagtgccggcatggcgacgttggctgttcccattgcaagcagtgaagaggcgtttaaccctaatgccgttaaagtggttatggatgctcagggttatgccctctacttttccagggccaccattccgtgggaaagagagcgctttgctcaatcaaaagagactatcggtgattgtttcttacgtcacatcggtatctatgcctatcgagcaggttttatccgtcgctatgttaactgggcacccagtcagcttgagcaaattgaattgttagagcaactgcgggtgttatggtacggcgagaaaattcacgttgcggtggcgaaagctgtgcctgcggttggggttgatacgcagagcgatttagaccgagtccgggctatcatgctcaatcaataaattgcgcgacggaaactttacgccagaacctaccgggctctggcgttgttatttctaacctcggtttattgcttttcgctttatttactgccttctctttactgattctcttcctccttattgcctcctttcttggtatcttgtggatgctgattatttaattttattattccttcctgacttgccgccgcagaggtatgagcgacgtgctttccccatacatcgtggtcgtgtttatactgcctggctaccccgccgatgacgttgagtatgtgcgggttatttgatctacattctggcaatctccggcctgtgatcccattatgataaaccacttgcgtcagataaccggactaagcctaatggaacagctgaaagctgaactcagtgtcattttaggggaatcaattacccgccttgaacggatcagtgaacagccttacgcccatctgtatgccatgtataaccggcaagatcaggcgatgccattattagcgaaaagctatgtttgccagggtattgcgcaacaagaggcttataaactgtcgatgctagcgcgggaaggggatattcgcttgccgacggtgtacggtttagtcatgacccaccaatcgccatataaagaaattctgctaatagaacgcatgcgtggtgtttctgtcgaggcaccgacccgaacgggcgaccgttggaatgccctgatggatcaaatagtggaagggattctgtcatggcatcgtattgatagccacgggtgtgttggtcacgtagagagtacgcaagaaaataattggtactgctggtatcaacagcgggttgacgtgttgtgggccgcgttgtctaacatgaacgcgccactgatgacccaggcggaccgtgcggtgctctaccgtgccaaagcatcattagcgctgcttttcgctgattttgacgacagttcagtgctggtccacggtaacttgacgctacgcagtatgctaaaagatgtacgtagcgaccagctattggcgatgcttaaccccggcccaatgctatgggctccgcgtgagtatgatttgtttcgtcttagcgaagaggggatgccaagccagctattgtatcgctatctcaataaagcaccggtctctgaagccttcgttgctcgccgttggctttatatgctctgggacctggtggctcgttttattcatacaggaagtctggatcgccctttatttgataatgcagctcggcagcttctcccttggttggattagcttgcttgttgattgattaaccagagggatctgtcgattcagatggtcactaccgcgatattttctacgatatttctgggttgtttttgtcctgccgttggctgttagcgcctgaatttcccgttaatcccctttttgtctcaccgaagggggataccgccgtgtctctccgaccgattatttgcgaagaaattggcatttacgaataaattggcatttacaaataaattggcatttacgaataaattattatttgtgaataaattggcatttagcgcccaattcggattaaacgtgtagccgccacggaggacaacactgtaatctacggggtcattatccctgagaagggaatgattgtttctccaatggcaagagacccgtcgtccttcaagatgcagggtagctgctattgctcacctccgtcacttagttatctaagcgcctggggattgacacggttgccgccaactctttatcagctaacactttgtaaacagcgttttgccgcttttctgtcagcaggcaaaccataataagatttttcagtctcactgagatgcgccaaagcggcggcggcattaatagttcatcgactctttttagagaaaaaagcataagaagggcgactttttggctgaaaaaacggcatttgattgcgattacggagggaatgggatttattctaaggcaggctgtgccaaaatgacgggttgttgaaaattctttttttgtggctattggtttacgtatctctcttggtggcagtgacatgatcaacgtgggtaaaccaatagtgataaagataataagcggagcagttgcccatgcaggatcgcaatttcgatgatattgctgaaaaattttcccgcaatatctacggtacgacgaagggaatgattcgtcaggcggtggtgtggcaagatatcactgagttgttgacgcagttaccaccgcgtccgctacggattctagatgcgggcggcggtgagggtcatatggcatgccaactggcggccttaggccatcaggtgctgttgtgcgacttatctgctgaaatggtccagcgcgcaaaagcggcagctcacgaaaaaggtgtgagccacaacatgcaatttatacaaagtgcagcgcaggacattcgtcaacatttagaacaacccgttgatctgatattgttccatgcggtattagaatggattgctgaacctcagcaggttctgcaaatactttttgatacgctaaaaccgggaggcgcactgtcgttgatgtttttcaatgccaacggattggtgatgcgtaatgcggtattgggcaactttcagttagccattcccggcgttaaacggcgtcggcaacgttcgttgtcaccgcaataccctttagacccaccaacggtatacggttggcttgagcaaatggggttatccattaggggtaaaacaggagtacgggtatttcacgattacatgaaaaataaacagcaacaaattgatgagtttgctgaattattagcgttggaacagcgctattgccggcaagagccctttattagtttggggcgctacgtgcatgttatggcgtttaagccgaatctgaaggacccattatgagtgaattttcccagacagtacccgaactggtcgcctgggcgcgaaagaatgatttttcgattactctgcccacggaacgtctggcttttcttatggctatcgccgcgttaaacggcgagcggttagacggtgaaatgagcgaaggcgagttggttgatgcatttcgtcacgtcagtaaaggttttgagcagacgacggaaaccgtcacggtacgtgccaataacgcgatcaatgacatggtacgccagcgcttattaaaccgttttaccagcgagctggctgatggtaatgccatttaccgcttgacccctttgggcattggcattaccgattattatattcgccagcgtgagttttctaccctgcgtctctccatgcagttatcgattgtggcacaagagctgcaacgtgcggctgaagcagcagaagaggggggagatgagtttcactggcatcgtaacgtctttgccccgctaaaatattccgtcgctgaaatctttgacagcattgatatgactcagcgtttgatggatgaacagcaacatagcgtgaaagaagatatcgcggcgttgctgaatcaagactggcgtgcagccattgccagttgtgaaatgttgttgtcagaaacctccggcacactccgtgagttgcaagatacactggaagccgcgggtgataagcttcaggcaaatttattgcgtattcaagaagcgactatcggcaatgcaggcttagatctggttgataagctggtgtttgatttacaaagtaaacttgaccgcattatcagttggggccaacaggccatcgatctatggatcggttatgaccgtcacgtgcataagtttattcgtactgccattgatatggataaaaaccgggtcttcgcccaacggttacgccaatcggtacaacactattttgataacccgtggacactcactcacgccaacgcagaccgcttactggatatgcgcgatgaagagctggcgctacgcagtgaagaagtcacgggcgagctgcctccggatctggaatttgaagagtttaatgccatccgtgagcagttaaccgccatgattgagcaggcgttgctggtttatcagcaacagcaaataccgcttaatctgggggaagttatgcgtgattacctcgcgcaatatccgcgtgctcgtcattttgacgtggctcgtatcctggtcgaccaggctgttcgcctcggtgtggccgaagccgatttctcagggttgccagccgaatggttagcaatcaatgattacggagccaaggtgcaggcacatgtcatcaacaaatattgaagtagtaatgcccgttaagctggctcaggcattagccaacacattatttccggcattagacagccagttacgtgctggccgtcatattggtattgatgagttggataatcatgcttttttgatggattttcaggagcaactggaagaattttacgctcgctataatgtcgagttaatccgtgcgccggaaggtttcttctatttgcgtcctcgttcaaccacgcttattccgcgctcagttttatctgagttggatatgatggtcggcaaaattctctgttatctctacctcagcccggaacggctggctcatgaaggtatcttctctcagcaagagctgtacgaagagttactgagcctggccgatgagagcaaattgctgaagtttgttaaccagcgctcgaccgggtctgatttggataaacagaagttacaggaaaaagtccggacgtcacttaaccggctgcgtcggttgggcatgatttattttatgggcaacgacagcaccaagtttcgcatcactgaagcggtattccgttttggtgcggatgtacgcagcggtgatgatcaacgtgaagcccagctacgcatgatccgtgatggcgaagccatggcggtagaaaatagtctgtcacttcatgatgaaagtgatgatgctgatgtcaccatgggcaatgcagcggacagtgtagaggatgaacaggaatgattgaacgcggtaaatttcgctcactgaccttggttaactggaatggtttctttgcccgaacattcgatcttgatgagctggtaacaaccctctccggcggtaacggtgcaggtaaatccaccacgatggcggccttcgtcactgcgcttatccccgatctgaccttgctgcattttcgtaacaccaccgaagccggggcgaccagtggctcccgtgataaagggttgcacggtaaattacgtgccggtgtgtgttattccaccttagatgtggtgaattctcgccaccagcgggtggtggtaggcgtgcgcttgcagcaagtggccgggcgtgatcgcaaagtcgatatcaagccattcaccattcaggggttaccaacggcgatccagccaaccgagatcctcaccgaactggtggctgaacgtcaggcgcgggtgctgtcgctaccagaattgaaagagcgcgttgaagccatggaaggggtgcagtttaagcaatttaactccatcactgattaccactccctcatgtttgatttgggggtgattccaaagcgcttacgctcttctgccgatcgcagcaaattctatcgtttgattgaagcatcgctgtacggcggtatttccagcgccattactcgctcgctacgcgattatttattgccagaaaatagcggcgtacgtaaagcgttccaggatatggaagcggcgttacgtgaaaaccgcatgacactggaagctatccgtgtcacccagtctgatcgtgatctctttaagcatttgatctcggaagcgacatcctatgtggctgccgactatatgcgccatgccaatgagcggcggattcacctcgacagtgcgctggtattgcgtcgtgatttattttccagccgtaaacaactggtcactgaacagtatcgccatgttgaaatgtcacgggagttggcagaacaaagtggcgcggaatccgatctggaaaccgattatcaagcggccagtgaccacctgaatctggtgcaaacggccatgcgccagcaggaaaaaatagagcgttatcaaagtgatttggaagagctgacctatcggctggaagaacaaagtgaagtggtctctgaggccagcgaacagcaagcagataacgaagctcgggcggaagccgccgagttggaagttgatgagctaaaaagccaactggctgattatcagcaagcgttggatgtgcagcaaacgcgcgctattcaatatcagcaagcgttgcaggccttggagcgcgctcgtgctctgtgccaactgccagagttaaccgccgataacgcggaagagtggctggaaacgttccacgcgaaagagcaagaggcgaccgaatcgctgttgcagcttgagcagaaattaagtgttgctgatgcggctcacagccaatttgaacaggcttatcaactggtggtgaatatcgccggtgaagtcagccgcagtgaggcttggcaaaccgcccgtgaactgttacgcgattggccttcccaacaacatctggccgagcgtgtgcagcctttgcggatgcgtttgtcagagctggaacagcgcttacgtgcccagcaggatgcggaacgcttgttgcaggagttctgtaaacgccaggggaatgcctaccagccggaagagttagaagcgttacagcgagagctggaatcacaggtcgaagaattgtctctcagcgtcagtgacgcaggtgagcggcggatggcgatgcgtcaggaactggaacagctgaagctgaagattcaggaactgaccgctcgtgcgccggtttggttggccgctcaggatgcactgagccagcttagcgaacagagcggtgaagcgttggaagacagccgtcaggtgacggagtatatgcagcagttgctggagcgtgagcgtgaaacgacggttgagcgcgatgaaatcgcggccagcaagcgcgccatcgaggcacaaatcgaacgtttgagccaaccgagcggggctgaagatgcccgcttaatcgcgctggctgaacgttttggcggtgtgttgctctccgaaatttatgacgatgtcaccattgacgatgcgccttacttctccgcgttgtatggcccatcccgccacggtatcgtggtgcctgatctgtcattggtccgtgagcacctgcaggggctggatgattgcccagaagatctctatctcatcgaaggggacccgcagtcatttgatgacagtgtgtttgctgtcgaagagcatgaaaaagccgttgtagtgaaaattgctgatcggcaatggcgctattctcgttaccctgaagtcccgttatttggccgtgcggcgcgtgagaaccggctggaaacgctatatcaggaacgtgaccgtctggccgaacgctatgccacgttgtcatttgatgtgcaaaagactcaacgtacccatcaggcattcagccgctttattggctctcatctggcggtggcatttgatgccgatccagaggctgaaattcgtttgttgaatacccgccgtggtgaaattgaacgagctctaaacgcacatgaagatcagaaccagcagcagcgtcagcaatttgatcaggctaaagaggggatatctgctcttaaccgattgataccactggtttccctgctattggatgagacactgactgaccgagtagaagagatcactgaagagcttgcggaagcgcaagaagcggctcgttatattcagcagcatggtgtctccctaaccaaactggagccgttgttatcggtattgcaaagtgatccacagcagcatgagcagttgcaggaaagctatgtactggcccaaaacagccagcgtttagcgaaacagcaagcctttgcactgactgaagtggttcaacgacgtgctcacttcagttacaccgattcggctggcatgttgactgaaaattctgatttgaatgacaaactgcgccagcgtctggaacaagcagaggcggagcgtacccgcgcccgtgagcagctacgtcagtatcaaagccaatttactcagtacagccaggtattagcttcgctgaaaagctcttatgacgccaaacgcgacatgcttaaagagctgagccaagagctggtggatattggtgttccggcggatgctaatgccgaggcgcgtgcgcgtgcacgccgcgatgagttacatgccgcgctaagcactaaccgttcacgacgtaatcagttagagaaacaactgaccttctgtgaagcagaaatggacagcttgcagaagaaattgcgtaagctggagcgtgattatcatcagattcgcgagcaggtggtcaatgctaaagcgggctggtgtgccgtgatgcgaatggtgaaagataacggcgttgagcgccgcttgcaccgccgtgaactggcttatatggatggtgacgaactgcgttcaatgtcggataaagccttgggcgcattgcgccttgccgtcgcggataatgaacatctgcgcgatgtgctgcgtttgtctgaagatccgaaacggccagagcgtaaaattcagttctatatcgccgtctatcaacatctgcgtgaacgtattcgtcaggatattattcgtacagatgatccggttgaagccatcgaacagatggagatcgaactgggccgcctgactgaagaactgaccgcccgtgagcagaagctggccatcagttcgaaaagcgtatcaaatattatccgtaaaactattcaccgcgaacagaaccgtatccgtatgctgaatcagggcctacaagcggtttcctttggtcaggtaaaaagtgtgcggctgaatgttaacgtgcgcgaagcccatgcgaccttgcttgatgtattgtccgagcagcaagagcaacatcaggatctgttcaacagtaaccggctgaccttctctgaagcgctggcaaaactgtatcagcgtctgaatcctcaaatggatatggggcaacggttgccacaaaccattggtgaggagttactcgattaccgtaactaccttgaattagaagtcgaggtttatcgcggtgctgatggttggttgcgtgcggagagtggggcgttatcaaccggtgaagctattggtacgggtatgtcgattctggtcatggtggtgcaaagttgggaagaggagtcacggcgcttacggggtaaagatatttccccttgccgcttactcttccttgatgaggccgctcgtctggatgcgaaatctattgcgacattatttgagctatgtgaacggttggaaatgcaattaattattgccgcaccagaaaatattagtccagaaaaagggacaacctataagctggtacgaaaagtcttccaaaatcatgagcatgtacatgtggttggcttgcgaggctttgcaaatgaaatgccttcattgccaccaatagccgctgaattgcaacaaggcggttaatgaacctgcataaaaaacagtaaataataattagttttattaaatggtcgcacagaagcggccatttttattttttgtaacatcttcgggttgtattttataaatgcaggaaatctgttagcgtaaaggtggttacttggtcaatataattgacagtcaaaatgtcacttctgtttgtataataaaataagaagcaatggtaccgacaaactatgacgtactgagatgagcatacaaggggcatggaatgtcgatgataaaaagaaagttacaacgcgcactcgttttatactgcgctttagtttgcagcctgatgaccgtgtttactgcatcagccgctgctcccgtaatgcccgtggattcatcttcagctttgccagcacgtggtgcaaccatgtccgtggctcaaagtcgttcgcaattattggccgcgcttccaaaagatgtcgtgccactctatgccgcggaattagcgtcattatatgcggcgaaccaaatgcagcctatgtggcaagaccgggttgctgttcaacgtttccagcaacagttagcggaggttgggctttcaggcattcaaccgcagtttatgcaatgggttaaatggttgagcgagccagaaatcaccggtatggcgcgtgatattattctatcggatgcgatgctgggttatttacactttatttccggtgtcggtgctaatggcagtgtttggttatacagtaatgtgccttataaaatggccatgccgcctgcagcagttttaaacgcctggcagaaagcggtcaatgaaggctcgacagcctcttatctggcgtcgttggctccgcagcatccgcaatacgataaaatgcaacaggcgttgaagttgatgctagcagaccgacgcccgtggccacagatgcctactgggccaagtttacggccggggcaacttagcgacgatatccctgcattgcgggaaatccttgaccgaacgggtatgttgcacccaacaacccccgtgaaagcgccagaggtgatccctgtggagaaccctacggtggccgtcgttaatgacgatctctctgttgatgaagaaaaaaatcggactcagaccaacagcttggtggtcagcccatcagccgtctctgtccctgagagcgatgatgcggcacccgcaccgatgcctcccgtgagcgtggtcacgttaactgacaatatctatactcctgagttggtagaagccgttaaacgcttccagcaatggcaggggctcactgatgacggtgttatcggcccccgtacccgcgaatggttgaatgtctcgccacaaacgcgggccacgttattggcattgaatatccaacgattacgtattttaccggggcatgttgataacggcattatggttaatatcccaaattattctctgaattattataaagatggggccgaagtgctttcatctcgggtgattgttggccgtccaagtcgtaaaacgcccctgatgagtagtgcgttgaataatgtggtggtgaacccgccgtggaacgtgccgacctcattggtacggcaggatatcgtgcccaaagcacgtaacgatgccgggtattttcagcgtaatggctataccgtgttgtccggatggagtaatgatgctgaagtgatcaatccttcaatgattgactggagtattatctcgccgaataacttcccttaccgtttgcgtcaggcaccaggtgctaataactcgttagggcggttcaaatttaacatgccaagttctgatgctatctatttacatgacacgccgaatcatggcctgttccaaaaggacattcgcgccctgagttcaggttgtgtccgtgtcaataaagcgtctgatttagcgaacatgctgctgcaagatgctggctggaatgatgcacgggtctcttccaaggtaaaacaaggtgataccacctacgtcaatatccgccagcgcgttccggtgcaattgtattatctgacagcatgggttgcggaagacggtaaaccgcagtttagaacagatatttacaattatgataaaatggtgcgatctggtgcacaaatctcacagcaggctgagtttttattgcaataaatgcagtaaaactcaataactaatggtcttaaataccgggctatcttgtgggcgcttgttcgtaagcgccctgtcacctgaccttaacgcacagtgaatgcgggttgactgctttttcataggcggttaaggttcggagcggcacatattcgaagcggcacatcatatatatagtgcctatagtgcttacttttgacattcttgccaggtattaacagagatcatggataaaattgataataatcgccgcaagtggctaacgttgggcggagttgcgttggggatgtcactgcttccagggccagtattcgccactctttctacgccacgcccacggattttgaccctgaataaccttaatacaggtgagtccataaaagcagagttctttgatggacggaattataacaaagatgaactttcccgcttaaaccatattttccgcgattaccgagccaataaagtcaaaaaaattgatccacgcctgttcgatcagctgtatcgcctacaagttctcctcgaaaccactaaaccggtgcagcttatttccggctaccgctccctcggcaccaataatgaactgcgtgaacatagccgtggggtggccaaacagagctaccataccaaaggtcaagcgatggactttcatattgaaggtatccaattgagttatatccgcaaagcggcattaaaaatgcgcgcaggtggtgtaggatattaccctcgcagtaattttgtgcatattgataccgggccaacacgggcttggtaaaacaaattttttagccagtgcctacgctccagttggtagtcacattggggttggagctttatgaaatatcaaattattccagtcacggcgtttagccagaactgtacgttaatctggtgtgaagcgacggggcaggctgccttagtggatcccggtggtgaggccactaaaataattgctgaggttgagcgtcagggggttaccgtcagccaggttctgttgactcatggtcatttagatcatgttggcgcggccgctgaagttgctgcacattttcaggtaccgatttatggccctgaaaaagaagacactttctggttggaaggcttacccgcacagagccgaatgtttgggctaagtgaatgtgaggcttttaccccgacccgctggttggaagaaggcgataaaataacggttggcgaaatagagttatctgttttgcattgtccggggcacacgccggggcatattgtatttattgacccgcaaggccgcctggctctggtgggggatgttatcttcaagggtggcgtggggcgcagtgattttccgcgtggcgaccatcaacagttaattaactccatccgcactaaattactgccgttgggcgatgatataacgtttattcccggccatgggcctatgtctacattggggcatgagcggcagacaaatccgtttattcgagaagagccggctatttggtgacggtcgtatttgataacggtaatatttggtgacggtggttagcgtcatcaatatcatacataaatttttaatagcaaaagatgaatgtttaatagcaaaagatgccggaaggcgtcttttgtgttctctttcgtttatccttgcggcttaaaattacgtcatcgagtgaccagtcaaaaggatggcttgggccatccttttgaggttattgacaaagtgcccgcgacggagagaacaggcagatcgtaaagacgccgtaaatacatccatgtaggctcgagccgcgccatccttggcgcggacgctttactcctctgcctatcctcaccgttcaagatcgcgtcatcggggtttgtcagcagtctgaaggatggcttgggccatccttttatggtcagtcaagggatgataacggatactgagttagagcaccgcaacgatagcttcacataacggcgccatattgtctggtgtcatccccgccacgttaacccggccagaatttaccgcatagacggcgaactcatcacgcaggcgcagcacttgttctttggtcagaccactgaacgagaacatcccattctggttaatgataaagctaaaatcttgttgagcgcctttttcctgcaaggtattaacaaacaactgacgcatacgttggatgcgctgacgcatatcggtcagttcttgttcccaaatcgcccgtagtgcggcattactcagaatagtggcaacgactgatgcaccatgtgccggtgggttagagtagttggctcggataaccgctttaacttggctgaatgcggtatcggcaacgttactgtcggcggcgacaagggtacaagccccaacacgttcattgtacaaaccaaagtttttcgaataagagctgcaaacgatcaactcttgatgtgttgccgcgaaaatacgcaggccctgagcatcttcttccaaaccgttggcaaagccttgataagcgaaatcaaacagtggcaaccagcctttagcaaccgataactccgccagttggctccactgagtttctgttgggtcgatacccgttgggttatggcagcagccgtggaacaacaccacatcacccgcctgagcttctgacaggctatttaacaagccatcgaagtccaatgcatggttagccgcatcataataagcgtactccaccacttccagccctgcggcttcgaagacgtttttatggtttggccagcttgggttactgacccagacacgtttagcgctggtctgatgggcgataaaatcagcggcaatgcgcaaaccaccggtaccacctggcgtttgagcggtacgagcacgtttatccgcaataattgcactattagcaccgaacagcagttcttgggtgcaactggcaaaaacaggcaggccgtcaatacccagataatttttggtagcttcattttccagtaaatactgctcagctttcttcacgctggtcagcactggggttttaccggtttcgtctttgtagacaccgatccccagattgattttatgagcgcggtcatccgcgcggaagatatcggtcaaacctaaaataggatccgcaggtgcagcagtaattttttcaaacatgtcagaggcttccatggcttagcgttaagcaaacagagccttcagggtaacgccagttgcggtctttgccaaccgtttgcgataaaaagaaatgaatctggtgaggcggggggatctgaggtgaaaaatcggcaaaataggccgatagacagagtaatctccatcaatctgctcaaaatagaaacaaaaagacagagccgaggccctgtcttttttcaacttaggtcagcagataaactgcctcgttaagtttgacttagaactggtaaaccaagccaacagcaacaacgtcgtctgtcatgattcggttaacttctgtgaacaggtctttgtccaacaggttgattttgtaatcaacataggtagacatgtttttgttgaagtagtagtaagtaccaacagaaacatatttcaccagatcatggttagcatcaacattgttcagatccttacctttggattgaacataacccagtgatgggcgcagaccaaagtcgaactgatactgtgcggtgatttcgatatcgcgagtcttgttcgcgatggtgaaatcataaaaaccgtatggagtcaggttctgagtctcagcatacattacagccaggtatacgttgtttgcgtcgtatttagcaccaacgttccatgcctgagctttgtcgccttcagcggtagaaccatatttttgatcaagagtacggtttgaagaagagaaaccagcaccgaagttaatgccattaccgagatcataagtagaaccgataccgaagccgtcaccgttagcttctttgatatcagaacggtcatttttgccttggtattgcagggcaaagttcaggccgtcaaccataccgaagaaattgttgttacggtaagttgccaggccagtagaacggccagtcatgaagttgtcagagttggagattgaatcaccaccgaacactggcagcatgtcagtccatgcgttaacgtcatagattacgccgtagttacggccatagtcgaatgaaccgaattcagcaaatttcagaccagcaaagcccagacgggttgcgttgccgtcttgagcgcctgaatcttcagcgttgtttgcttgaatgttgtattcccactggccgtaaccggtcagttggtcagtaatttgggtttcacctttgaagccgaaacgaacgtaagacttgtcaccgtcttggccagctgcatcagagaaagagtgacgtgcgtcaactttaccgtacaggtcaagtttgttgccatctttgttatagatttctgctgcattagctgcaccagcggctaacagagctgggattactactgcaagaatattgcgcttcatcattattattaccctcattggtgttattcggacacctgccactgccgccaataatttttatggaactattgttgagagtttggtgtcgtctgtgtctgaacgcagtgttccattcacagaccttataatccagaccgaaaatgctaccaattacaataatgtgtttcattaagaaactatgtgttacaaaatgtaaaattaagggaactttgtgacttagatcgaattttaaaaaatgataaaagccagcagagctggcttttatttgtacaaattgacgttattttctaaataataaacttagaaactggcatttctcggtgtgcgtgggaacggaataacgtcccgaacgttttgaaccccagtgacatatgagattaaacgctcaaatccgaggccaaaacctgaatgcggtacagtgccgtagcgacgcagatcacgataccaccaataatcttctttattcaggcccatttcggctaaacgcgcatccaagacatctaaacgctcttcacgttgtgaaccaccgatgatttcaccaatacccggcgctaaaacatccatcgccgcaacggttttgccatcttcattcattcgcatatagaaggctttaatatctttcggatagtttttaaccaccaccggcgctttaaagtgtttctcagccagataacgctcatgttcagaggacaaatcaataccccatgaaacatcattctcaaacttctgaccggatgccagcaagatctcaatggcatcagtgtagtcaacctgagcaaaatcagaggtgacgaaacgttgcaggcggtcaaccgcgtctttatcgacacgttcggcaaagaacttcatgtcatcagcacgttcattcaagaccgcctggaaaacgtatttcaacattttctcagccaaaccggcgacatcatccagagaagcgaaggccacttccggctcaaccatccagaattcagccaaatggcggctggtattggagttttcagcccggaaggttgggccaaaggtgtaaacctttgataatgcacaggcgtaggtttcaccgtttagctgacccgatacggtcaggaacgcttctttaccgaagaagtcttcgctgaaatcgacagcaccggtatccgtgcgtggcaagttttccagatctaaagttgaaacacggaacatttcacctgcgccttcagtatcagaggcggtgatcagcggtgtagaaacccagaaatacccattttcgtcgaagaagcggtggattgcttgtgccaacgtgtggcgaacacgggcaacggcgccaatcaggttagtacgcgggcgtaagtgagccacttcacgcaaatattcaatgctgtgacgttttgcggccatcgggtaggtatccggatcatcaacccagcctactacgttgatggcggttgcttgaatttcaaaactttggccttcacccggtgatgcgaccacggtaccggtgacttcaacggaacaaccggtggtcagatgcagtacttcatcctgataattcggcaaagtattattcacgacggcctgtaacgggtcaaagcaggaaccgtcataaacggcaacgaaggagatacccgctttagaatctctccgggtacgcacccaaccgcgcacggtgacttcactgccaaccgcggcgcggccttgcagtacgtcgactacaggcactacgctcatagatttctctctttaatggtttggatataaaccctgcttccttgaagttgcagtgtgttagcggctctcactcatctgaatctctgacttgagtcagttcatcagaatttgcgcacttactgcctggctacaactttaatgacttagggtatagaaatagttaacaacccaatgaaatggggatgttgctatgttacttgtggcggtgcaggacacaagtagaaatcatcagaatagtgcaagatttctgaggttaccgtcaatatgccctccgtccttgcaaccactagggggttagcggcatttttgcacccagatcactcacccgctgacgacaatagctttgggtataaatacgacacaaacgaagacattatttaatagtagaaaatttaatagtagaaaatttaatcgtagtaatagtagaaaatttaattgtggaagaacagagaggctaaaaaatatcagtgttggggttaccgggtaaacatacgctacccggtaacggggggattaactggctttcttgactaacggtagcgcaaaggctttacgtaattgatcaacgaatgcggggtcctgacaaatagtcttacccgggctatctgagagcttagccaccggtttatcgttacattcaaccagtttaataacaatattcaatggcttaacatctggtatatcgcacgtcaaacgcgtaccgataccaaacaccaacttaatgcgctgataaaagtgacggtagaggaataatgctttctccagatctagattatctgaaaacaccaatacctttttcattgggtcaatacccaatttttcataatgcgcgatagccttctccccccactcgatcgggtcaccagagtcatggcgtaggccttgatagcggttggcgaaagccagatcaaaatcgcgtaggaaagcatccatagtaatgcaatcagttagtgcgatgcccagttgattggggtattcatccagccagacttgcagtgctacacgctggctgtttgccaatgttgggctaatttgttggtgagcctgaaaccactcatgggcttgagtcccgacgggcgctaaggctaatgtgcgggctaagtcgtagttgctggtgccgaccagataagggaactcatcttttaacgtgctgacaacggtgtgctgtatctcgcgagagaatcggcggcgggtaccgaaatccatcaatttaaagtgagtaatatcgatatccgcactgagggcattgaattgctcaagttttgtgcgcagttgttgaaccgcttgatccgttgtcacttgggtagagcggcggcggtgaacgatttcgctgatcactgccagcaaaggcacttcccacatgatcacctcacaccataaaccggcaatgcgaatatctaatttaccgtcatgaacagcgacggagacttgctctggtttaaaacgaaaatcgcgcaaccaatgcagataatcatcctggaagaaggggagactggagaggtaaataaactcatcagatgtcagtgctaattgacccatcagggttacctggtggcggatttcatcagcatacacccccagcagctcatcactacggcagcggaattcggcggcaacagtaatgtgacgataatgatgaaatacggcttgttgcatatgaagcttatatgcgtccgtatcaagcaatgaagtcaaaatcggtgaggcgtcttgagtcatggcgctatacagcatcctcgtaggagcattttccacagtcggcaaaatctataaagttgcaggagtataccggtattatcctgttattgaagcctcatcacaccataaatgctaatcagaagtctaagactaatgtgccatcgtcaggaaaaaccgatttgattaagtcctatgtctatctttgattcagtacatagactatctatcgtggattttttcgttagtttactacgctgatgaaataacattatgaaaaacatggttaataacgaaatcattataaataatcgctatattgatgtcttttctgaattggtagcttttctaacattggtagcttttctaaattgatagcttttctgaatcgatagttctcctgattttcccggtttctcttgcgccctattaaacataaaaagcagattttgtcggcaggttattttgttaaatgtgtgaatttgtgcactacccaatgtgcttattggtgacgaattgcaaaacgacaatgggcttgcgggacgactcgaaaaatggacattcaatgcgttatttgccggagtcgcctgggttctcatctaggttttttttacaactgtgatacattgaaaacctatctgggtctgggggaacgtcgctaatagcagcgaaattcaccccaattacgacaggcacagacccgataatcatactcactgatgacgtcaaaagggtttctatgacacaacagccgcaagctaaataccgtcacgattatcgtgcgccggattacaccatcaccgatatcgatctggacttcgcactggatgcgcaaaaaacgacggtaacggcggtcagtaaagtaaaacgtcaaggaacagacgtgacgccgttgattctaaatggtgaagatctgacactaatcagtgtcagcgttgatgggcaagcatggccacattatcgccaacaggataacacgctggttattgagcaattacccgcagattttacactgacaattgtcaatgatattcatccggcaaccaacagcgcgttggaagggttatacctgtctggtgaagcgctctgcacacagtgtgaagccgaagggtttcgccacattacttattatttagaccgtcctgatgtgctggctcgttttaccactcgcatcgtggcggataagtctcgctatccatatctgctctccaacggtaaccgtgtggggcagggtgaactggatgatggtcgtcattgggtcaagtgggaagatccctttccgaagccttcttacctgtttgctttggtcgccggtgatttcgatgtgttacaggataaatttattacccgttcgggtcgtgaagtcgccctcgaaatttttgttgaccggggtaatttagatcgtgctgattgggccatgacatccctgaaaaactcaatgaagtgggatgaaactcgctttggtctggaatatgacctcgacatctatatgattgtcgctgttgattttttcaacatgggggcgatggagaataaagggttaaatgtatttaactcaaaatatgtgctggcgaaagcagaaacagccacggacaaagattatctaaatattgaagctgttatcggccatgaatatttccataactggacgggtaaccgcgtcacttgccgcgattggttccaactaagtttgaaagagggcttaaccgtattcagagatcaggagttcagctccgatttaggttcacgctctgtcaaccgtatcgaaaacgtgcgggtaatgcgggcagcgcagtttgcggaagatgccagcccgatggcacatgctattcgcccggataaagtgatagagatgaataacttttatacactcaccgtgtatgaaaaaggttcagaagttatccgaatgatgcatacgctactgggtgaacagcaattccaagcgggtatgcggctctattttgaacgtcatgatggcagtgctgcgacctgcgatgattttgtacaggtaatggaggatgcatcaaatgtcgatctgtctctcttccggcgttggtacagccaatcagggacaccattattgaccgtgcatgacgattatgatgttgaaaaacagcagtatcatttattcgttagccaaaaaacgttaccgacagcggatcagccagagaaattgccactacacattccgttagacattgaactgtatgatagcaaaggtaatgtcatcccattgcaacataatggcttgccggttcaccacgtgctgaatgtgactgaagctgaacagacctttacttttgataatgtggcacagaaaccgattccatcgctgttgcgtgagttttctgcgcccgtaaaattggattacccttacagtgatcagcaactcacgttcctgatgcaacatgcccgcaatgaattctctcgctgggatgctgcgcaaagcttgctggcaacttacattaagttgaatgttgctaaatatcagcagcaacagccactgagtttaccggcgcatgtggcagatgctttccgcgcaatattgctggatgaacatcttgatcctgccttggccgcgcagattttgacgttgccctcagaaaatgaaatggccgaactgtttacgactatcgatccgcaagcgatcagtacggtacatgaagcgatcacgcgttgtctggctcaggaactgtcggatgaactgttggccgtatatgtcgctaatatgacgccggtttaccgtattgagcatggtgatattgccaaacgtgctttacgcaatacttgcctcaattatctggcctttggtgatgaggaatttgccaataagcttgtttcttcacaatatcatcaagccgataatatgacggattcattggccgcattggcagcggcggttgccgctcagttaccttgccgtgatgagttgttggcggcctttgatgtgcgctggaatcatgacggtttggttatggataagtggtttgctctacaagcgaccagcccggcggcggatgtcctggtacaggtacgtaccttactgaaacaccccgcattcagtttgagtaatccaaaccgtacccgttcgttgattggtagttttgcttccggtaacccggctgcattccatgcggctgatggtagtggttatcagttcttggttgagatactcagtgacttaaatacccgtaacccacaagttgctgcgcggttaattgagccgttgatccgcctgaaacgttatgatgcagggcgtcaggcgctgatgcgtaaggccttggagcaattgaaaacgctggataatttatcgggtgatctgtacgagaagataaccaaagccctggcggcataattcaatgtgatctaatcagtcaatgtgatctaattgaatagagggtccgatattctctcagattgttggcaaactccaatgacgtggccttaaatggtggatagtcgggatagtcgggatagtcgggatagtcgggatagtcgggatagtcgggatagtcagatgtccgtgccacggatggcgcgattcaaaccccatgggtgctattttgatgtagggaatttaatgcagggaataccgtgtttttacgatttgcctattctcttcgttgtgtatattttgtcattaattccctctattttttacctgcctgttattacggttaacaccacagtaacttaaggtaataaaggatacggttagtatgtttattctttaaatggctttacttcgcaaacgtttactttcctgaaagatgaatttaccattcccgtatctatacccaagtgacttcaagatgcaggcagcaaccgagtaacgaagaccatcaacgcatctgcaacttgacgtatgatgggtagatccatacgttggaagcgggtcagctagcgggattagacaacagtgctgataacgttaactggctacagcacgacagaattagtgcttgctaaccgcttgtcactgatcgctcaggagatcacatgtattatccacttgtcagaaaagcactatttcagcttgatccagaacgtgcccatgaattgacttttcgtcagttaaagcgtgttagcggcacacctttggaatttttggtacgccagtcggtacccaccaaaccggtcagttgtatgggcctgtcttttaaaaatccagtaggtttggctgcgggcctggataaagacggtgagtgtattgatgccttgggcgccatgggctttggtttcattgaagtgggcactgtgacaccacggcctcaggtggggaatgataagccgagattattcaggatcgtcgaagctgaaggtttgatcaaccgcatggggtttaataatcatggggtcgacaaccttattgaaaatgttaaaaaatcccattttggcggtatattgggcattaatatcggcaagaataaagatacgccagtcgaacaaggtaaagaagattacctgatttgcatggataaaatttatccttatgctggatatattgcgattaatatttcctcacctaatacaccggggttacgatccttacagtacggtgaagcattagatgatttgttagctgcaattaaagataaacaaactgagctacatcaacgccatcataagtatgttcccgtagcggtgaagatcgcgccggatcttactgaagaggaattgatccaaatagcagatagcttggtccgccataatattgatggcgttattgctactaatacgactttagatcgttctctgattcagggattaaattattgcgagcaagccggtggattaagtggccgcccattacaattacgcagtactgaggttattcatcgtttatcacaagagctaaaagggcgcctgcctattatcggtgttggtggtattgattccgttactgcagcacgggaaaagatggcggctggtgcttcattgattcaaatctattccggatttatcttccgtgggccgggtttgattaagaatatcgtcactcatatctaattatttatcttcattacctgctgggggtttatttctgcccccggctagtctatattttactccggtagattgaatattcagcaaaatgcttaaaaatgcttatatgaaaagagtcccattcgatgggtctagaactcagctattgagtttatgatatttcaatatgatgggaaggattaaatatgcgaattaagccagacgataaatggcgttggtattttgatactgaacacgaccgacttatgttggatttagctaatggtatgatattccgttcgcgcttcccctctaaaatgctgacaccagatgctttcgatgaatcggctttctgtgttgatgatgcggctctttattttgaatttgaagatcaatgtcgccaaattaaattgagcaatgagcagcgctcagaattggtattaaatgcattggtcgcatgccgtttcttgaaaccactcatgccaaaaagttggcattttgtacagcaacctaaagttctgataccacaaaatggcgaactgacgttggttacagtattagacaacggagaaaatgtccgtttgctcgtggttgaaccgggctgctccgccagtttatgcttattagcacaatctcaagtggtattagccggtcgtcagttggtacttggcgatgcgataaaaataatgaataaccgtttattaccacttatggttgaagaggttaacaccacaacagcgtatgaccgtgcggtataatgtgtcggtgtgtttttgaatgcggttatttgccactaagggaaatatcgcctttagggatgcaactgcaacaaagaatggttccatcgttaccaacggcgctttttttgagtgcagcaacatcgccagtgagtaatgtaactctgcaactgccacatatcccggcccgacacgaataagggatgcggatattctgctgttctaactgttccaatagtatttgttgattattgccgttaaagcggatgccattatattcaatggataccgtttttgactgatcctgcggcgcactaaggctttcaacaacggctccggcaccgtagggtcttggcggtttggtgatcagaacttcaacttcgtcgccaactcgaataataccgctgttcctggccaccatattctggccaaaatcgacatcaccattctccgcagttcggaacgtctgtaatgttcgcaatggttcgccggctggatgtttttgcccacgctcaacactgacggtcgttaatacacagcggctgcaaggtttgactaaatcaaatgtgatatcgcctatccgaataacctgccagcaatcttcggcaaaggccgtggtacccgtaatcactaaattcggacgaaactgttccagtttaatactggcggggcaacgttgctgcaaatctttaaatgacgcttcgttaatcagcagataagggaagccatcagcaaaagagaggggaacctccggcaacggtttgacccgacgtgttaattctgtgccgacccaacgcagttgtacgtcacgctgaaaataaccacttaaccaactgttgatcgcctcgggtgcaattaacgcagtaaaatgatttccccaaatttcagtgggggcgggattggctaaaaaatcattaaagcggatactggcactctcgccatcgggtgcggtgagatataaaccgtccgccattaatgcgggggtaaacatcaccatcttcggatattggcgtgcagtaatgaacatgccgtccggttcggtgatcataaatacgcggtcaaaggccagcccgctgcggctaacctgggcgtgggaaagctgcaaaccacgcatagatttcaccggatgaacgtaaagtcgggagagggtaatcaccattacctccgtgtgagtattaaattagagggagcaactttatgacaagctgctgggattagctataatgcgcaacaattttctttttggtgatagtgcgatatgaactctctgtttgccagcacggcgcgtggactggaagaactgttaaaaagcgaactcgaagcgctgggcgctcacgactgtaaaatagtacagggtggggtacattttcagggcgacgatcgactcatgtaccaaagcctgttgtggagccggttggcttcgcgcatcctgttgccactcaacgagtttaaggtctacagtgatttagatttgtaccttggggtacaggctatcgattggccctcaatctttggtgtggacaaaacatttgccgtacattttagcggtgtgaatgacgagatccgtaatagccagtatggtgcgttgaaagtaaaagatgcgattgtggacagcttcacgcgcaaaatggatcaacgcccaacggttgccaaacaacagcctgatattcgggtgaacgttttcttgcaacgggatatggccagcgtggctcttgatctcagtggtgaggggctacatcagcgtggttatcgtgatttgaccggtcaggcaccgctgaaagagaatctggcggcagcgattatccagcgttctggttggcagccaggtacgcctatggtcgatcctatgtgtggctcagggactttgctgattgaagccgcaatgatggcctctgatcgtgcaccgggtttgcaccgggggcattggggttttactgcctggaatgcttttaatgaagcactgtggcgtgaactgaccacagaagcgcaagttcgtgctcgtcgtggcctgctagagacttcatctcgcttctttggttcagatattgatcgtcgggtcatcgaaatggcgcgtgcgaacgctcggcgggcaggtgttgccgagttgattaccttcaatgctaacgatatcagtaagctggtgaatccattacctgaagggccggtgggtactgttatcagcaaccccccttacggcgaacggttggaaagtgagcctgcattgattgcattgcataatatgtttggccgtatgatgaaaaccgcatttggcggctggcgtctgtcactgtttagtgcttctccagaattattgagctgcctgcaactgcgagcggatcgtgaatttaaagccaagaatggcccgctggattgcgtacagaaaaactatcagttgacggcgaatccacagggggcggggggcgcgttggtggctgaagattatgctaaccgtctacgtaagaacgtgaaaaaactggataagtgggcgaaacaacagggtatcgaatgctaccgtctgtatgatgccgacctaccggattacaatgttgcggtcgatcgctatggcagtaaagtggtggtgcaggagtatgcgccgcccaaaacgatcgatccacaaaaagcccgtcagcgcttgtttgatgtgattaatgctacgttggcggtgctagaactgccctctaatcagttggtgttgaaaacgcgtgagcgccagaagggtaaaaatcaatacgagaaattggcccaaaagggtgaattcttgctggtcagtgagtataacgccaagctatgggttaacctgactgactatcttgatactggtctgttcctggatcaccgtattgcccgccagatgttgggcaaaatgagccagggcaaagatttccttaacctgtttgcttataccggtaccgccagcgttcatgcggggctgggcggcgcgcgcagcacaaccacggtagatatgtcgcgtacctatctggagtgggcagagaagaacttgcgagcgaatggcttgacgggccagcaacaccgcttaattcaggcggattgcctttcttggctcagcaacactgatgagcaattcgacgtgatcttcattgatccgccgaccttctctaactccaagcgtatggaaaccacctttgatgttcagcgcgatcatttagtgctgatgaaagaacttaaacggttactgcgccgcaaggggacaatcatgttctcgaacaataagcgtggtttccagatggatctggccgggatagccgcgctggggctggaagcgaaagagataaccgcacttacacaatctgaagactttgcccgtaatcgtcagatccacaattgttggctggtcacccacagccaagaggaaaagtaaaaactatgtcgttaattagcatgtctggagcctggctgtcgttcagcgatgcacctttattagataacactgaattacatatcgaggcgaacgagcgtgtttgtctggtgggccgcaacggtgcgggcaaatccaccttgcttaaaattctaagtaaagaagttgcattagatgatggccgaatcatttatgaacaggatctgattgtggcgcgtctgcaacaagatccgccgcgtaatgtggccggtaccgtgtttgattttgtggctgaaggggtgcaggaacaggctgaacatctaaaagcctatcacgcaacgctgcatcaggtagaactggatccgagtgaaaaaaatctcaatcgcttagcggcattgcaagaaattctggatcaccaagggttgtggcaactggatagccgtattcaagaagtgctggttcaactggggttatccgctgatgctgaactttcttcactgtcgggcggttggttgcgcaaagcggcactaggccgtgcattggtaagctcaccaaaagtgttattactggatgaaccaaccaaccacctggatatcgaaaccatcaactggctggaaggcttcctgaaagagttccagggcagcattgtatttatctcccatgaccgctcctttattcgtgcaatggcgacccgtattgtggatttggatcgcggtaaattggtttcatggccgggtaactatgagctgtatcttgccagcaaagaagaagccttgcgggttgaagagctgcaaaacgctgaatttgaccgcaaactggcccaagaagaagtctggatacgccagggcatcaaagcgcgccgtacccgtaacgaaggccgcgttcgtgcgctgaaagcgttacggatggaacgttcgcagcgccgtgaggtgatgggcaccgccaagatgcaagtggaagagaccgtacgttctggcaaaattgtcttcgatctggaaaatgttaattatcagattgatggtaaagtgctggtgaaagatttcaccgctcaagtacagcgtggtgacaaaattgcgttggtggggccaaatggctgcggtaagacgaccttactgaaactgatgctcggtcagcttaacgcggacagcggtaaagtgcattgcgggaccaagctggaagtcgcctattttgaccagcatcgtgcggagctggatcccgagcgcacggttatggataacctggcggaaggtaaacaagaagtgatggtaaatggccgctcacgccatgtactgggctatctgcaagatttcctattccaccctaaacgcgcgatgacaccggtgaaagctttgtctggtggcgagcgcaaccgtctgttattggccaaattattccttaagccaagtaacttgctgatcctcgatgaaccaaccaatgacttggatgttgagacactggaattgctggaagagatggtcgatagctatcagggcaccgtactgttggttagtcatgaccgtcaattcgttgataactcagtgactgaatgttggatctttgaaggcaatggtcaaatcaacagcttcgttggcggctattatgatgcgcatcaacaacgggcagaggccaagccgattcgtcaggccgcacttaagattgaagaaaccaaagcgtctacttcggttaaaagccctgcacctgcggctaaaaaacccggtaaattgagctataacttacaacgtgagttggatcaattgccgcaacagctagaaaaattggaaaatgatatcagcaagttacaggctgaagtcagtgatactgatttcttttcccgcccacacgaagagactcaacaggttttgaaaaccctggctgatactgagcaggcgttagaggtggcattcagtcgttgggaagagctggaagctcagaaaaacggctaaaaatgcgttacaccgttctgccaggtgacgtaatgttgtgctttgtgatgatattgtgtttattgttacattgagtctcttgatagaacggtgttcagctataaaggcctgccgtaaggaaatagatattgtgtgctgttattgagcctgttaatggtgggcaatcagggagtattctcctgtgccagcagtgtgatatgtcagtggccttaccccccttgccttatggcactaaagcggtatgcccccgttgtaaaacgacactgactgcgcggtgggaagagcctcgcaagcggccaataggctatgcgcttagcgctctgtttatgctgttgttagctaatctattccctttcgtcgatatgcgtgtggcggggatcaccagcgaaataagtttgatccaaatccctcaagtgatgctgtctgacaattacatcagcatggcaacgctgtttatggtattggttcagctaatccccgcattttgtatggtagcgattattctgctttgcctgcgggtgcgtatgccaatccgttggaaaaccgccatggcgaaagcgctgttccagtttaaaacctggtgcatggttgagattttcctcgccggcgtattggtgagtttcgtcaaactgatggcctatggtgaaatcggtattggcagcagttttatcccttactgtttattctgtttgttacaagtgcgcgcttttcagtgcattgatcgtcattggatgtggcaagacatcgcccctgcgccagcagtgccttaccgattgatcccaggccgtactggcttgcgtcaaggtttacgctcctgctcatgctgtacagcaattttgccgcaagaccaagtagagtgcccgcgttgttatacccacggttatgttcgccgccgtaatagcttgcagtggacgatggcgttattagtcacttcgatcctgttatatattccggcaaatatgatgccgataatgataactgaaagtttgggtaaccaaatgaactccaccattatggctggggtgatttttctctggagtgaaggctcttaccccgtggcgttggtgatttttattgccagtatcatggtgccatcgttaaaaatgttggcgattgcctggctctgttgggatgccaaaggcaagggcaatactgatactgaacgtatgcattttatttatgaaatcgtagaatttgttggccgctggtcaatggtcgatgtctttgttattgcggtgctttcatcattagtccgtattgggcagttgatgagcatctacccggcgattggggcactactgtttgcgatggttgtgatcctgacaatgttttccgcattaacgtttgatcctcgtttaacctgggatcgaatcaatgaaacaactcagaaggagccgcaaggtgacggacaataatcccagccagagtgtggcggaaattgaaaaaatcaagcgatggtcaccggtatggatcatcccgatcgtcactgcgctgatcggcgcatggatactgttttatcatttcagtaatcaagggccacaggtcgttttgaccactctaaatgctgaaggtattgaggcggggaaaaccaagataaagagccgtagcgtggatgttggtatggttgaaaaggtcacgttgagtgaagatcttaaccatgtgatcatacaggcccggttaaattctggcatgaataccctgttacacggtgatacagttttctgggtggtaaaaccgcagattggccgtgaagggatctctggtttagggactctactctccggtgcgtatattgagctgcaaccgggcagtaacggtaaggcactaaatgaattccgtttattggattccccaccgcttgcctcaccagatgcgaaaggtttacggattatgctggatagtgatcaagcggggcagttgaatgccggtgatccggtactgttccgcggttatcgcgtaggttccgtagaaaccagtacgtttgatcctcaatcccgtttgatgcgttaccagctatttattggcgcgccttatgacagcctggtgaccagtaacgtccgtttctggaaagacagtggtgttgctgtggatctgtcttcacaaggcatgcgtgtggagatggcatcgttggcgacattattcagcggtggagtcagttttgatgtacccgatggtttagaacaaggtaagcccgtcacgcaggataaagcggagtttaagctgtttgatgaccgtagcagcattcagaactctttatacattgaacatgaaaacttcttattgttcttctctgattctgtccgtgggctacagtctggcgcaccggtagaattccgcgggatccgtgttggtacggtcggagatgttcccttcttcgctgaggggatgaagcagcaagtcgataatgatttccgtattccagtattaattcgcattgagccgggccgtttccgtgatgatttaggtccagataccaattttgaacaggtactgaaaaccgccaaagagcgtggtttacgtgcatcattgaagtctggcaacttactgactggtgcactgttcgtcgatctggatttttatcccgatgcgaaaccgtggaaagggccgcaagaaattgctggttatcctttgttgccgacaatcagtggtggtttggctcaaatccaacagaaagtcatgcaaacactggataagattaataatctgccactgaatccaatggtgaatgaagtcacgaaggcattggctgaaagccagaagacaatgcgtgaaacccagaaagttctagcttcacttaatacaatcacgtccagtcagtcgatgcaggagctaccaaaagatctgcaaaaaacactgaatgaactgaatcgtagtatgaaaggcttccaacctggttcaccggcctacaataaaatggtgggtgacatgcagcggttagatcaggtcttgcgtgaattacaaccggtattgcgaacactgaatgagaagagcaatgcgctagtatttgaagcagcaggaagtcaggatcctcagcctaagaaggccaaaaaatgatgaaatggatggcagttatcgtcgcgctgttactcagtgcttgcagcagcgaaaccagcaagacgtactatcagttaccggcacttaatcagttaccggcacttaatcagttaccggcactcaatgcgcctgctacagtcagtagcagcgtagcatcacggcagttgtgggtggaacatgtcagtgtggccgattaccttgcggcggttggtgtggtgtatcaaaccaacgatgtgcagtatgttattgctaacaataatctctgggctagcccactagaccagcagttacagcaaacgttggtgaccaacctgagttattcgctaccggggtggctcgtctctgcgcagccgttggatagcgatcaggatgttctcaatgttacggtaaccgggttccatggacgttatgatgggcgtgcagtaatacggggtgtctggatcctaaaacatcaggggcagttgattaagcagcctttcaatctggagcttaaacagagtgaagatggctatgatgcactggtccgtacattggcagaaggctggcaacaggaagctaaaactatcgccgctcaattgcaaaagattaagtaagatctttttctaaatcagtctaatcctctttctctggtaataatcatcttgtcaggggaagggggtttctatttaatatcaatgcattaccttcatatgcaccaaatcaatgacttagctaattctgtggatgtagctcacaaatatgacattggcgtgaattttgcgcattgcttttctgttttttaaggtctatcacttaactgtggttgcacataaagtagccactgttttctttccaccaaaccaaaaagtgagggaaacgaggcatgaagagacagaaaagagatcgcctggaaagggcgttgtcacgtgggtatcaagcaggtatttcagggcgctcgagggaaatttgtccctatcaatctttagacgctcggtctcattggttaggagggtggcgacaggctatggaagacagggctgtgaccgcttaagcggctctctgtcattatcaagggtaacctccgcattaggcggaggttttcatttattgcgttagtccacccagcgtttcagtaagatacttgcgttcaccccaccaaagccaaaaccattggaaagggcatacgtcatgtcatgaggttgtgcgttacctgcaataatgttgagtcccttggctgcaggatctggattttccagattcaacgttgcgggcacgatttgatcacgcaatgccagtacagtgaaaatggtttccagcccaccagcagcgcccaacaggtgccctgtggcggattttgttgaggtaatcgctaacgcattactctcgccaaacaaatgtttaatggcattaatttcaccgagatcacctaccggtgttgaggtcgcgtgggcattcagatgctgaacttgctcgggcgtaataccggcctgacgcaaagcgattttcatggcgcgataggccccgtcgccatcctcagcgccagaggtcatatggtaagcatcggcactggtaccatagccgactatttctgctagtggcttcgcgcctctggctaaagcatgctccaactcctcaataatcagtaaaccagcaccttctcccatcacaaaaccgtcacgggcagtgtcgaaggggcgggaggctttttctggtgtgctattaaagtgggttgataacgcacgagcggcagcaaaaccggccagactcacggtatcgatcacggcttctgcgccaccgcacagggcaacatctgcttcattgttgcggatcatccgcacggcgtcaccgattgcctgtacaccggcagcacaggcagtgactggtgcgccaatcgggcctttaaaatgatgtttgatagaaacatggccagcggccaaattcactaagaatgaagggacagtaaacggtgagaggcgttttggcccacggctgtcggaagtccgcactgcatgggcaatggccggaaaaccaccaatacccgcgcctatgattgtcgcggtacgctcttgtttctctgtgttatccgcatgccagcctgcctggctaattgcctcatcggccgccgccatcgcaaactcaataaagcgatccattttcttttgatcttttggggtaaccgctttatctggatcgaaaccagctttagcgtcttctgctaacgtaggcacttgcccaccaattttagcgggcaagtcaccgacaatttcatccgatagaacacggatgcctgattgccctgccaagagccgttgccagaccgtttcgataccgcagcctaatggggaaacgacacccatacctgtaattactacatggcgtgtactcattctttttccttttaaactcgattgaacaggagacaacccagaaggccgttctccataagacggttatttaatctttactgaccgtttttatgcatgaatgtcagccgttcattcattatatctcgcttgaccgggcctgctaagagtcagtctcagttaccaagaaggggtctcgaattgcataaggggttccaagctaagttatgtatactctgtggaataaatacttatggatgagcgattaaatggattctctcttggtaacactgacagaagcagtggtcagcatatttaactttttgttttctatagcacgtatcattactcgtgttatctattcactcactagcggcccttactggaagcgtgtattaatcaccacgagtgtattcagcgttattgtcggagcaataacattctttgtcatgagatgaggcggacgactggtgacgggaaatggcggtggtctaagaaatggccgtgctttaaaaagcgctaatagtttaaaaagagttaatagtttaataatcgttaataatataagaaatgtcagtaggttaataagtgttaattgtctcactcaaccgggcctggcggtgaggctatctcctgaatctcatgtggtatatcacgtaaaaacaataaggcgacatgattaatcatattcgccttattttacaatgcattgacttattcgtattagaaagcgttggtgtctttaaacagacctactttcaaatcagtggcagtgtaaatcactttgccatcaaccaagacttcaccatccgcaacgcccataattaatttacgcataatcacgcgtttaaaattaatacggtatgtcacttttttcgcatctggcagcacctggccggtgaatttaacttcaccaacacccagtgcgcggcctttgccttcgccaccgagccagccgagatagaaaccaaccaactgccacatggcatcaaggcccagacagccaggcatgacgggatcaccgataaaatggcaaccgaagaaccatagatctggattgatatccagttccgcttccacataacctttattatggctgccaccgtcttctatcattttgacaatacggtccatcattaacatattgcctgcgggtaagggtggcccaccagcgccaaacaactcgccacggccggatgcttcaaggtcttcttttgtataggattcgcgtttatctaccatgttctcagtaagccttatgttagtgaagtgcgcagaatagcgtacagctgtacgctgagcaagtccgattagccctggttgaaccagtttagccagcgtaatggccatggccagcggcgtttatcctgtgggtttatctgtgcgatacgctcctggatagcgcctaacaggctgggttgctgctcatcgtcataagtgaccccagtcaataatggtagcgcttcagccacggtatcgacagcccacaggtggaattgacctttctgtaccgcttcaaccactgcttgattcaggcacaagtgacgaacattcgtggtaggtaaaatcaccccctgattgcccgtcaaaccacggcgttggcaagtttcgaagaaaccttcaattttttcgttcacgccaccaataggttgtacgttaccaaattggtcaacggagcctgtaaccgcaatttgctgattgataggctgctgtgaaagggcactgaccagcgcacaaagctctgctagtgatgcactatcgccatcaacctcaccgtaggactgctcaaacacaatggatgcggagaatggcagtggttggtcaagttccaattcagacatcaagaatgcctgcataatcatcatgcctttagcatgaatattaccgcccaattccgctttacgttcaacgtcaacaaattcgccatcgcctaaatgaaccacacaactgatccgtgcgggttcgccgaacgcgtgagggtgaccgggatattccagcacggataaggcattaatctggccaacaacgtgcccttcagtctcaaccagaatttgccccagctcgatctcatcttgcatccgttcggcaagataattttgccgccaatttcgggcattcagtgcggcttctagcgcgttagctgagatggtgtcattttcagcataaagcgccgcttctgcgagctgctgagtaagccattgcgggcagagcggcaggctgccttggtcgccactgtaacgcacggcttggcggaacaggaccggccaggcatcggcagataaggcagggagctgcttttgttgcaatagggtgttgatgtaaccgcaccatagagccatgccttcgatatctaccagggggagttctgcctcgaactcaccataaatcgccagatcacctagctcgggttccatatcatggaaatcggcaagccctaaacggtcaccaaccagaatcaaacgcaggtccagtggcatggagggaatatgcactggcagcgggcgggtttcatcggtagagagccaatcaaagcgttgttgaactatcatttgcttcaaacgcagccacatcaatggctgagcttgcaaggcccgtaccgacaagatcaatacaccaccatttacctgatgaactaaacccggttgcagcgtaatttgatctttatacatcctgacacagccaaacaactgttccggctcgacccattcttgatagagacaggttgattgcgcagcaaaccgttcatcaccgtgctgtgctgattgccaggtgacgtggtggccatggaccagataatcgccaccaagcaggttggaggcctccggttgtagcgctttaaccgcttgtgcgatcaatgccagatagtcggtactctcctgtgctttgattagcataaaccgcggttgagattgcggatgacagaacagcgtcatcccattctctagccggggctgataggctgaaaaagcaacaggctccaattgggaggcagtagcaaataacgcttcatatggcgttgtgttcggcagcagtgactgccattcgagtcggttattggtcaaagtgatagatgcaatcgtcaaaaagggaaagggcgattatacaagaataaagcaggctgcatatacgtagagtggctcttggtggtaaggagtccgatatgttgtgtgttccgtacaaaaaacaagctaataatgcgcgtttagcagggtgaaattctgtgtaaagctgttatgcttggcttaagttacacggtcactgaagagctcacgatgaaatatcaacagctggaaaatcttgagagtggttggaaatgggcgtatttggtcaaaaaacaccgtgaaggtgaagccattacccgccatattgaaaacagtgcagctcaagacgcagtagagcaactgatgaaactggaaaatgaaccagtaaaagtgcaagagtggattgacgcgcatatgaatgtcaatctggcgaccagaatgaaacagactattcgtgcccgtcgtaagcgccactttaatgccgagcaccagcatacgcgtaagaagtcgatcgacctggagtttttggtttggcagcgattggcagtattagccagacggcgtggtaatacgctttcagatactgtggttcagttgattgaagatgctgagcggaaagagaaatatgccagccagatgtcttctttgaagcaggacttgaaagatattttagataaagaagtttaaccggtagcgggtgaaaccaagataagcgatttagtcagctgttggctgaatcacaggataaaaaaaaccccgcatagcgcggggtttttcacgaaagaagttaacttaagcctgtggctgagtcacaacttctttgtagcctttcacttcgatctctacgcgacgatctggtgccaggcactcaatcagagcagcacgtggtttcacgttgtcacaggtgttgcctgtaactgggtttgcttgaccttcaccgcgagcagtgattttgtcagcagggatacctttagaaaccaggtagtcacgcacgctgtcagcacgacgctgagacagagctaagttaggcgctggttgaccgatacggtcagcaaagcccagaacaactacagaaccatctttaggatcgatagagctcagttgtgcgtacagttggtccagagcttgctggccttctggcttcaggtttgctttgttgaaaccaaacagcacatcagattttaatgtgaaacgcttagtgtcaacaattggcgctggagcaggtgttggagcaacgattggcgctgctgcatcttcctgaccaaagcggtaagaaacaccaacactcaggaggccgttgtctggacgagcaccaacggtttcacggtcgccgatgttgttaacccactggtattccatacgggttgcccagtttttggtccatgcgtattcagcacccagagctaccaatggagaaacaccggtatcatggccgctagcacggtcaagaccaccatcgaaggagcctttagcatctgcacgccatactaaaccacccagacgggtatatacgtcaaggtcttgtgctactgggtagctcagtttagctgctaactgaacgccttgagccttgaaagcgccattattgatgtcgcctttgtaaggcatacgaccaagccagtcgtatcccatctcaaagcccaggtactgatttgcttggtaaccgaagaacgcaccggcacccagctgatctttatgagttggaccatcgttattgatgatagaaccagtatcttgatactgagaccaacccaatttaccaccggtgtaccaggtgttatcttttggtgcggcttgcgctactgtagcgaaacctaccagtgccactgctaatgcgatagctgtctttttcattttacgcctcattatcatccaaataggcaatgagctttaaaagctaagcccttggttaaaattcttcgccaaggtttttacgctcccgttaattacgttgcctgtatgatttggcattttagagcaaccttggcgatgtaaagtctacaacgtggcgagaaagttacaagtgtgatgtagtaaaccgccttaaaaaaacgcataacgctataggaattttaacgatttagaggtgtaaatagcatttttttaggcattattttattcgtcaagccgcattctgactcgatttgcgccacttctttagggctaaattctgaatattgtgattattcatgggataaatcctaaattcacttaatgatacaaataagaatgaatttttaacgtggcgcactgtcctgaacccacttttgtgtcattcaatgggcgcataacaaacccataagcatttcctaacttcgcggctaaacgtaatctgatacgatcatcttccgtcaattcgggtaaccagcccagaacaacactgtaattaccggttaataatgctttttccatggcctcaacggtcgataatggattgatttgcctgagttgcacaactttattgattggcagccctgattgctttaaccatgaacggcttaatttctgttgtggggtgagccataaaagccaacgagattgtttactaagctgctgtaataaaggaagtaataattgcgttactacgggttgattttcactgtaaacaaattcactgataaggccgctatcggttggagcatcaactcttgctggagaatcgttggtagtaagagaatgataattagcatgataaggtttaagtgattgagtacgcattatgaacccgcctgtagtgtgctgtatgcatatacagtagtcactgtttaatcgaagatcaactaaattttataagacgcttcgcataattgtgatgcaaatacatgtaaatccattttatgtttggctacgtaatccatattgcgtatttttgcaattagttgttcctcttacacttattgctacaagacagggacattggttaggatttttactaaaggagtagtcatgaaaatcatgtcagaaaaaaggatcgctcaagcacaagttcgttttggttttctggggcagataacaattcgttcccaatttgggggctatggtctattggttaatagcatcatgttcgctgttgtttcggaaggtgagctttatttgcgtgctaacgataatattgaggatttattccgcgccagtggaatggctaaccttgtttatgctaaacgcgggttacctgtcttgctacgttattatcgggttgatacttcattatggaatgatggactcagattacatcatttcgtccggcaggcttatgagggcgcgaaaatagacgttctgagtaagaaaggcccagtggtacggctgaaggatttacctaatcttagcgccagccttgaacggctattatggaaagtgggtataaagaatgcgactgaattacgccttgaaggcgctaaatgttgctacttgaaattacgggcgttaaggcgctctcttgggattaatattttgctggcgttggcgggggctatcagtggctatcattatgctgctttgcctttgatgatgcgcagtgagcttatcgaatggtttgaaaaacacatccatccagcaaaggctccattatatgaaacggcataatggtgtgagccagtgtaatggggggagtcagcataactgtgtgaaacagtataaccgtatgaaaccgtataatgggccacgatgggtggcccttgggtaccttaggctggctggctaatacgtttatttaattcgctgagttccggtagcagttcaagcagcaaaccaatttgttgtaagaccaataggtctctgctctctggttctggatgacagtgctgtagccggttggataactcagctaacgcacttgccattctagcgttgtctggttgttctttcgccagggtgccctcaatatagcaaatagcatcattgagcaaatttagcgtggtgctattggtcaatttttcacgatgggcacccagagcagaaatatagctcaacatggtgtggttcaggcaaagtaagcggaatgccgcttcctgagtttctttatcgtttttgggttccgctgacatattcgaaataactgacgctaattcagcatcgcaattatgtgcatcacggcgggcaacccgataaagtaagctattgtccttaccttgatgatattgcgccaaaatggcatccagatagcggcaattagcattaaatgttttatgaaccaccgtaggcagttgacgaaatttccaatccggccagataaaactgacggctacccaagcaatggcacaacccaacaaggtatcaaacacccgtggtgcggccacctcaaacccttcacccaaaaggttaaagcacaataagactagcagggtgataaacatcgtcgcgtgagcatactggacattacggaacgcaaaaaacagaacaccactgatcacaatcagggtgagttgcccctcaagagaaggaacgaaataaaggataggcaaaccgacaaggataccggctaaggtgccgataatgcgtagcgcaaggcggcgacgggtcgcactatagtttggctggcagacaaaaaggctggtcagcaagatccaataaccgtggcgtaacccagtgaattgaatgaatgcgtagcccacacacaagacaatagacatgcgtattgcatggcgaaatagtgctgattgcggtgttaaatggcggctgattcgtagtttgatatcactccagccagtgaggcggtcatctgacaaatggttatcaggtgttgggtcttgcgctaagacttgctctgactctatccctgccagttgtgcatcaatagcgcgcaaattttttagcaagtaggaaagtgccttaacttgctgagtattttcgtgatgagccagctcttctctggccagtgcggcatctaagaacgtaaatgcccgttcgaaacgtgggtcatgctggtatttctgatgcatcagaatggattgggagagttggttacaggccttagcttgcatactcagtaaacgctgaaatctgaacagaacatcactgtaacgaaatttttctcgcagaacctggtattgaaaatgagatgaactggcccgctcatggatatcttgcgcaacaaaataatagtgaagtgtccggcgagtgcctcgttgaccacggtcaccttttagtcgggtcacgagtgaggctttggcctgattcaaggtggctactaatgtactgttgaccatcgccacgtcgattaagggttgattaatatcagattcaatatctggatcaaacaaattggcctttgcttccaaataatgagccaactgttggtaacaacgggctaaattatcctgtaagggacggatagggaaaataagatggccgaataaggtgagtacgttataccaaacagcacctgatatcagtaagagtggttgctggtaccaagtagggtacatcgaggcacctagcatagtgtaaatagcaatgagcaacgcgccgaaagcaatagtggcatagcgctgccctaatgcacctagcagtgtgaagccacaggttgataaggtcagaccgagagcaaaaaaccatgggtaaggaaatagcaactcaattgaagatgaggctacaaaaaagcaaattagcgtaatgaataagttacgtaaccgcccggttaggcggtcatcaagatctgtcagtgctgcggcaacgacccctaatgttaatgggatagtcagtttgggttgttcaatccaccatgggacggctgttacgcccaccaaagcgataaaaatacgggcatgataaagcaggctactgttgtatgcataacggcgtaaatcagtgacgaaagtgaacacaaaaacctctaaaacagaaaaattcagtgttaccgatgctggcgttgagcattagccactctggcttgctgcgccacttccaccgaaacgactcgacggccaactggccataaggcgatggcagcaattttaaaattggtgatgcctactggaataccaattatggtcatacactgcacaatccccgcagtgatatgggataaacataaccaccaaccaaataatataaaccagacaatattcagtaaagcccctcccgcagtgaacagagcattacttttttctggatataattcattgacgtggatcgcttcattaccataaggcaggaatgataacttggtgatttcccagcaagagcgggttaatggtaaggtgaagatcaaaatgacactgaccaacgttgctaatagccagcctagcgtcgtgaaaaaaccacctaaaacaaagttaagagcattcaatacagtacgcataataatgagttttcctcgttgagtgaaaaaaccgcaatgtggctgagcgatagcctatgctaaccattcacactctcaatgcaggttagtttctgttaccaactatcggatacctgttgtttaaactcaattattttatttacactccatcatgttacttcaattcacttgatatgggttatggcgcgcagatatggaacttaaagcgacatcttttggcaaacatctgtctcagcatccctataaccgggtccgcttgctgaatgcaggcatcgaagtctgcggtgataaacatcaatacctaatcccttttaaccaactggttagtattcagtgtaaacgaggtatcgtttggggcgagcttgaatttgagttgccgcagcagaaagttgtacggttgcacggtactgaatggcaggaaacacaacatttctatcattacttgctaggggtatggcagcaatggagtgaagaaatgagccaggtttgtgcggaggtgctacataaacaggtggagtcaattaagcgaattgaacagcaggataaatggtttaaacgcagtgaattaggccagatacaagtcatgatccgcgaggcattcagtgccttaccaatgccagtggaacgcttagcggcgtttgaatcctgtcgagcagattatgaatgctgcctgcgttggttacagcaaggtcgtcacagtgttgaacgatgtaatcagcaatggacagcccgtatgttggaggagtatcaagattttttccaaaatgtagaaacttcgccccttaatgcctcacaaagccgggcggtggttaacggtgaagattcagttttggtgttagccggcgcgggtagcggtaaaacatcggtgctggtggcgcgtgcgggctggttgctacgtcgtaatgaggcactacctgagcagattttattgctggcatttggtcgccaggcggccgatgaaatgaatagccgtattaaacaacgcttgggcgtggatagcatccaagctaaaacttttcatgctctggcattacatattatccagcaaggtagccgcaagacaccggttatcagcaagcttgagtctgatagccaggccagaagggcgttgttaattcaacattggcagcaacagtgtagcgagaagaaagcacaggccaaagggtggcgagagtggctaactgatgagttggaatgggacgttgctgacggcgatttctggcaggacaaaaggttggctgcgaggctggcaagtcgccttgaacgttgggtagggttgatgcgtatgcacggtggcagtcaggctgaaatgattgagcaagcgaatgacgaggtgcgtgacctgtttcaaaagcgtatccgtttaatggcaccgttgctaaaagcctggaaaacggcattgaaagatgagggtgccgtcgatttttctgggttgattcatcaggcggttaacttgctggagaaagggcgctttgtcagcccatggaagcatgttttggttgatgagttccaggatatctcaccacaaagggcgatgttactcgcggcgctgcgtaaacagaataagcaaacttgcctgtttgcggttggcgatgattggcaggctatttaccgcttcagtggtgctgaactttcgctgacaacggcttttagcgagcattttggtgaaggtgctgaatgtgcactggatacgacttaccgctttaatgatcggattggtgatattgcgaaccggtttattcagcaaaacccttatcaactgaagaaaccacttaatagcttgagtaagggtaataaaaagtcggtcatgattttacccgatgagcagttggaggccctattagataaattaagcggctttgttaaggacggcgaacgtatcctaatattggcgcgttaccatcatttacgccccgaagttttacaaaaagcggcgacgcggtggccaaagttgactatcgattttatgaccatccatgccagcaaagggcagcaggctgattatgtcattatcgttggcttacatgagggtaatgatgggttcccagccgcggcgcgggaatctgtactggaagatgtgttgctacctcctcccgaagatttccctgatgctgaagagcggcgtttgctttatgtcgcaataacgcgtgctaagcaccaagtgtggttactacaagatacggcacggccttctatttttgtctctcaactcagtgaattaggtgccctggtacaacgtaagccctagcaaacataataaagcgatgctcaatactaaacccggtggttgaaccaccgggtgagttacctattttaggtccaggcgctgttgcatgtaacggtcataatcagggatggcgatagtgacttcgctgctaaacagggttgagccaattaagaaatctgcagtagagcggtttgttgctactggaatattccatactgttgccaggcgcagcagggctttcacatctgggtcatgtggaacggcattgagcggatcccaaaagaaaatcaggatatctatcttcttctcagatatcagcgcacccacttcctgatcaccgcccatcgggccactgagcaaacagtgcacatcaatacctgtcgccttctgcactaaattaccggtggtccctgtggcatagagttcgtgttgtgccagtagatctctgttttccatcacccatgcgagcagtgatttcttacagtgatcatgggaaacaagggcaatgtgtttgcgagccgcaatagtgcgggtagtcagttccatctagatatccttcagtaatagccaattggtttgctaacagattactgaaagggtgattttgtgcatagtagcaacacaaaaaaatgcgagaaagtaggcataacctgatgattaaacacggctctgggggaaatggtgccgatgacagaggttaactcgctaataagtggcgtgctttttagtggataggttgtttttttgcccatatcaggaaacgtttctgggtttctggatttgcttgcaagaaccaatattgcagcatttgttcggtgacattttcaccttgcaaactggccgttttatgtggggtattgacgccagcaaccggaattgtcgtaccgggcactgcactcaccggtgagggggggattgccgcaaacgcggggacggatgcgttgtatttcccaacattatatgccgccattactgtttcaagagtcgtactattatttagatggtcttggcgtaaaacgtcgtgacgtacagataacgggtgcccattgtcgccaataagttgatataaaggatttttggagaattgatgcccatctcgtagggtgttaattaccggtaattttatggcaactgaccgagtattatgagcattaaacactacgattaatggtggcgaagaataaagaactaaggggtctgtaggtagcggctttatcactttaaacagaatctgatgcataccactgtttaattccaaactatccgcacctttcaataaggagccagacatatttttgccatcgacgacgagcaggtcaatttctggcgtgagttttaatgtcatcgcgacagaggaaaaactaaagcagacggccaacatccctgcaaccagaccaagtttcatgtgttactccttaaggtgatactcgcttacattgtcaggtaagccagatcatgtgtcaaagtctttccaatccattgtatttgtttactattcggatcattctggatgggggcattgatttatcttaatgaattttaagaataaaaacaatttagtggtaataatatctacaactgttcaatcaaatcaattggatggtgttttttatcgattctttttacatgatgtacacttagaaaactcgctaatagtaggtaatccatcgaaaagtgaagggtgtggaatattcttttagcgtattagaggaactgaataatgcatgataaagatatcgccgacatactcaaaaaggtaaaaaccatagcattagtcggggcgagtgatatcccatcacggcccagctatcgtgttatggcgtatctgctacagcaggggtatcaggtcacgcctgtcaatcctaaactggccggagaattgctgcttggccagttggtttatgctgaattagccgatatcccacatgctattgatatggtcgatgtgtttcgtaattctgatgctgcatattgcattgcacaggatgccattgctattggtgctaaggtgctgtggctacaaataggtgttattaatgaacaagctgccatattggctaccgatgcagggttgcaggtagtgatggatcgctgccctaagattgagcttccccgcttgggattagaaaaagggtgacgttccgtgtaccgattctgggctttctaaaaaagcaccctgtcagcgtgctgctcacagggtggcgaacctggcaatcaacaccggtttgacattcactgacgtggctcagttacgtaggtgcggagcctgtaactggtggcgaatcgaggccgccagttcatctaatgaaggttgttctgggtgtgcatccacatcttcataagtcagttgcgcttcagccagataggtatgtaccggctgcccatcgtcatcttctattaccacatggtaccaaggtgatgaacgtaaggtcttgttgttggcaacctcatcaggttcaggtggtgcaagagaatattcaggatcgatatcaatcaccactcccaaatacccgtgcaggctgtgacgaacctgctggcctataccgaatttgctggcgatcatgataacctcccgagaacttttcactgtcttgtatatgagggtgtcgcaggatatttcaagttacattacccgacacgcgaacccttttagatataaaccttctggataagccgcgatcactgggtgatccgcagcttggcggaactgctctataaactgtatgtcatggcctgcatctaacgcggcatcggccaaaattttctggaataaatcgaccggcatcaaacctgaacaagagaaactgagcaagataccgccagggcgcagtaattgaatcgccaacatattgatatctttatagccacggcatgcactggctaattggcttttattctcaacaaatttaggtggatccataatgatcaggtcgaatttttccccttgagcgcgatagctgcgcaacaattggaatacatcgtcacggacaaactccgttttgctcagatccaactggttcagttcaatgttttgtttcgcaatatctaacacggattgcgatgtatcaacactaatgacctgttggcaattgcccatcaacgcggcgacagcaaaagcccccgtgtatgagaagcagttcaaaacacgacggccattggcataattacgggccgctaagcggctatcgcgttgatctaaatagaaacccgttttatgaccttgctggatatcaacgaagagttgcatgccattttcgctaattggcagcagggctggtggcatttcgccacagataaggccttgagtcagtggcaaaccttcttttttacggacagaaacatcggaacgatcataaatagaacattctggatagcaatgttgtaacgcactgaccagcgtttcacgttgatattcggcaccggcagaaagtaactgtaacaccaagaaattctggaaacggtcaatggtaatacccggcaggccatccgattcaccggcaatcaggcggtagccattaaggccatcacgctgtgccagccaatctcgccaattctgagcctgttgtaggcggcgaataaagaatgcgcaatctataacctcatcttgttggaacgtccagactcgtgccaaaatttgtgattcaggcgagtaggcggcacgggccaaccattttccctgactatcaaggatatctatggtttcaccggaaagtgcatcaccttcaaggcgttgaaccgccccagagaaaatccatgggtggcgacgaagtaaggatttttcacgtcctttagcaagaataaggcgtacggtcataattaggttgctgccatctaggtaaaaaagagcgatattgtctgagtatgtgctagaaaatgcaaactatcacgcacagatgagggaatgattatgtcaaaaatatatatcgttgcgtatgtctacggtgtagttcagggggttggctttcgttacagcacccaacggcaggcgcaacagcttggggtgaccggctatgctaaaaactgtgatgatggtagcgtagaagtggttgccagcggcaatccacaagcagttgaacgtctaatggagtggataaggcagggcgggccacgtggggcgcgagtcgatcgcctgttaactgagccttatccgccaacgccatttgagacgttcagcattcgctactgatgaaagcgttatcattgctgaaatgatggtcattgcgcgatgttccgcaggttaaatgcatttaaccggtttaggaagccccgcgattttcgttgcttgtttcgccggtcctttagggaataaacgataaaggtagcggctgttgcctttctcttcgccatatttctgtgccatggcttttaccagcatgcgaatcgcgggcgacgtattgaactcttgataaaaggcacgaacaaagcgcaccacctcccagtgaggttctgtcagtgtaataccttcttgctccgccaacacaggggctaaagcttcgctccagtctgtgctgttcttcagataaccttgtgcatcggtatcgatgattcgaccttcaaactccaacatgtaacctcaataacgcagttaatgaaatggcggctaatttagcaaatatttgcccacatcccaaaaaagtctgcatttagataggcaaaaaagcctctgcagtggtacagatcaccatccgcgagcattgatggtgatgattaattcatcatttaactgtggagtggtggtttttttggtcaattaaactcaaacgggctttacaagcttcgatgctctgtttatagttcggctcgttgcggaggggtggccgagtggctgaaggcaacggtcttgaaaaccgtcgacgggtaaccgttcgagagttcgaatctctcctcctccgccattattttcctttatattcttgtttttcccgtgtatttcccccaaaaaaaccattcggtattccatatcccattcactgtccttagactaaattggttgatattgggatagataaacggttctgtcgcattaaggcgcagttcggtaacatgctgttttttttggcgatgccacctacccatgccgttaatccgaaaaacctttaaacgcctacattatcccgtcgatatcatcgtgcaatgtgtttgctggtatctggctgatgccctgagtctgcggaatctcgaagagacgatggcagagcgcggtgttatcgttgaccattctacactgcactgcaccgctgggttatacgtctggttccgctgctggataaagcctttcgtcgacataagtgcaccgtggtgcgccgatggagaatggacgaaacctacatcaaaattaaaggccagtggaaatatctgtaccgcgcagtggacactgcaggccagaccatcgatttcctgttgactgccaaacgggatgcagcagcggcgttgcgcttctttcgtaaggccattcgacaccaaggtgaaccggaggtcgtgactatcgataagagtggtgctaatacagcggcgctggtcacgctcaacgcagataaagcagaagatgaagcgattaccatcaagcaaatcagtattggcaaacaaaatgaagcaagatagttttacatgtaataataaatagcagttatatatatttttaatatcatttatttttatttacagaatatggtgagcatagggaatgattttaatatcctaggttattaggatagtttccttgtgtataaaaatctaattataatacaaaaaccttgcttattacatcccgatcttatatatccaatatatactcacgaagtatttttttatggatataataactcattaataataaaaattttaatcgcgtttcatgtgagtaatattctgtaaaataatgtgaaaaatgtgttttttgtaagttctattaaacacatcagtttacagcaatgaattcaccattgtgcatcgtcaataaaaggagtatttatgaaaaatcaatggcaacatcaatattttttatcctattctgagttagttgcaaactttccgtccccagaaaaagtagtaagtgattatattaaacataagtttagtacaacacttccatggtttggctgggcagaccctgacaacctttattttatccgatttactcaaagccgtagtaacaataaatcttataccggatgggatcatcttggtaagtatgccattgaaacgttaaccctcacacaagcagcaatagttaatattggaagtcgttttgatatctttgacgaagctaattcaactgctggaatatataaaacaaacaatgctgatttttttgacgaaacaaacgaagcaaaaatgcttccttccgaatacttatattttttgagagattgtgatttttctaatctctacaataaagcgctatcagattactgggctgagaattacgaaaaatttagcacattactacaaaactattatatttcatcagcgtattatctatataaagatagtgctattagtaaagatgaatatgaactctctattgatgctatttttaataaaaaaataaaatattgcgttattactttgatgtttatgggtattattcatctgatatgtttgttgctatgaatgataataaaacaatgctttttattccgggggcaaccaatccctttatcttcgcagacaacattacagatttacgcgacaaaagaaaggcgttaatttctgataaaaatacccgtgagttattttctaagcatttttatttatattaccgacaagatggaaacacgtatttaggtgttaattcaatgctcgaacagattgttagtggtgtggtagatactaattacataatgtattctaataaaaacattcgtgaacgtaacgtatttgaatcaattaagttaattatcaataagttagtaggtagtgacgaaaacatacttaataaaaataatcttgctgattttttggaaaagtacaatattagcgagagtgatattccagaaaatggctctttagttattaatttgaaaaacactaacgtacctgttcgtcttgttaaactgaatgatgaagagggcgaaattgttgcaatcaaaggaagcacattgagcgggatttactacgaagtagatactgaaacaggttatgagatattgtcacgccgggtatttcgaaccgaatataatgaaaaaatttactggacaagggggggaggactgaaaggtggtcagccatttaacttcgaggggcttgatattcctgtttattttatagataaaccatattctgaacttgcatcttcagtggaactttcatttgtgaatgatgatagccctttgttattccctgaaatggactccagattaccaaaaccgactccagagttagatataaaatactactcttctaatttatcttcttttaaagaagatacggtaattctaatgagaggaacgacataagaagaagcgtggaatattgcaaactataaaacggcaggtgggagcaacaaagatcttgatgagaactttattgaggctggaccacagttcaacttaagtttttctgaatatacatcaagcattaacagtgcagatactgcaagtagaaaacattttcttgtgattatcaaagtacaggtaaaatatattagcaatgataatgttctttatgctaatcactgggccattccagatgaagcacctgtagaagttcttgcagttgtggacagacggtttatcttccctgaaccaccagtaaaaccaaattgataagttttctcctcctccagctttacctggcagggggaaatgaaaagatatctaacaagcaattatcaagttcgccttatctccccgtccttcagggcggggagataaggcgctgagattccatttagttgttcgctcctggctgatcgccatgctcctccaactgctgcacgtcaacaaatacgccgtcagggtcgtattcaagccggagcctttgcagcctctcccagttctcagcggcgaagcacttgctggtctcgcccgcccttgtctcaagatcatactcgttgatataacgactacgggcaatttcctgaagctcgtcatacatccgttttaaccaatatttattgacactgtcatcttttgcatcgtcccactgggcgtaggtcgatacaaaaaacttgccgtgtgccgaaaatgctgcttgcggataggtggtcacaccccgccagaaaatcgttgtaagggcaccccgagacggcgcgtctgataaatatcgggataggatggaaaccaattcctgtgtgttatctgtaaggatattgtcggcataaaacctttttgataccaccatgctgctgaactgctcataaatggtctcgaagtttgagggctgattgatggccaaggctgtaagtggcagctctaggcgggtttcaaaagattcacatagcgcttgcgcctcttgcgggctatcggtaaacgccaaaatatttaacagtactgctggtgtgtcacccgatgtcggggggctgacagacaccatcacctgaagatttgtagggggagatgcgtcttcaagtctcgccaataaatcgtgtaaatacgtgaaaggtagcgtatataagctgttggttattacccgaggcagtgagtagcaactgaggtaaaaacgggtcacaacaaaaaacgaacagggtccagcgccacgagcggcccagaacaagtctggctcctgggtttcggaaacatggcgtagacgaccgtctgcggtgacaatgtccaaggcttgtacgttgaacacactcatccctccccattggctacagttgatcccgagccctccccccaacaggaatccgctgatacccacttcttttacatgtcctgtcggaaaagccaaacctttagccgccagtgcatgacacaattgaccactactgaccccagattcaacgatggcacgcttgtgccggctatcaatatcaagtcccttcaagccggaaatgtccaacatcagcgtatcaacgcgaagaaaacaaccgacgtagttgtgcccacttccacgaacgctcacttccatgcctcgctccttggcaaagacaatcgtgcggatcacatctgcctcagtcgcggcgcgtactattccagcaggtctacgtgttgggcctcgaccgttccagacactggtgagataccactcatcaaaggcgggatgcgaagcaagacgaacctcgccatccagttgcgatgccagcttcagttgagacagagaagtctgcgtagcggcggggatccccagatcctggctgacaatggaatagagtcgtttgggtttgaaccccaagcgagtcttgatgtgggaattcaagcggccgcactcgataagattaattcctttttcgaatgcatagcgatacacggcagacacgcccaaggtgtaagggctgaaatcggaactctcatcatccatgccggccgaccagaaatggagagcgccgtcttcctcgaagcagataaagccgctgacaatctgcccgttctgttctacgacgataagacgaaccagatcgccgcaaagacggcaaaaaacagccaattgtgattctggccaataatagggcgtccccagccgttgggtggtcaaataatacaaccgggccagtttctcaatttcattatcaaagggaggagcaagtattcgaactttcgcatcgctgcggttaaagatacgaagctggcgtaccatttcgtaacgcctgtacttgggcaaagcctgcgcaaaactgtcaaaatccggaaaagcatccagttcgattgaaaatttatccaccatgtagtttatatttagcccattacgttgagcctcacgcaagagcaccccatcctgtacattgagaaaacagaaataacgcgccagctcagcctgtgcgatagccgtaatagcatcgaatattcgtgcgtaaagacttgggtcgtgacttaacgtcggtatcgtggtatccgtacaatgtataatatggctaaacagtccgcgctcttcagattctatcgagagcttagcggagaaaatcaataaccctaacgggtcagcggaccgaaattcttgaagataaagcggaaccagcgcaatcagcctcccttcgtctcgcgcaagcaaatagaaaattttactgacgtttaacaagggtgactgctcagccgcgataagaaatcgcagatcgtaaaacaggggtgctttgctttgaagaaaaaacgcgcgatactcagcaggatctaggtctttagcgctattgataatatcaagggtggtcgtcattaaagcctccatagtttatcggattggcagacaatttgactgagtggcaataggtaacattaagaaaaacagcatgttacctttctgcatcttaatgcgacagaagcccccagtacgcctgattttcgcttattgcaacaaaagcctttcttcttactgtgctgtgtatccaccatctatcgtaatcgtctgtccggtaatcgctgtcacgttatcttctgcaagaaaaacaatagtatgtgcaacttcttcctgagtggtaaaacgcttgtttggcatcatttctataaatgcttttttattgttttcatcatggcctaaaaaacgatcaaacattttgccttctactggcccgggggaaatcgaattaatcctaaccccagtagtcgcaacctccagcgctgctgttttggtcaatccctcaattgcgtgtttacttgcgacataaatcccagtgctagggaggccaacgagaccagcaattgaagatatattgatgatgctgccttttcctctttccaccatcacaggtatttgatatttcattgccagcagagtacctaatacgttggtattgaataccaaatgaaagttatcttgggttacggcttggatctctgcagtttcacctaccgtgcctgcacaatttaccgcgacatctaacgagccgaatcgctccagagtcatctcgataaggtgcttgatatctgattcactattcatatcagcattaacataaagtacgtctttattaatgcgtttcaggtcatctaatatcactcttccttcttcgggtcggcgacctgaaaacacgacattatagcccatttcagagaataacttagtcgccgtattcccaatcccagaaagagcccccgttatcaatattgtttttttcatgtaacacctattttatagagtaaggttcgatacatgtcattgccatcaaaatactattgatggcaacttcaattaatttcacttaaaaacaaaaaattaaaacaagtatgacagataaaaatattcataccctacatattcacctgaatttactgttcctatactctagactagggagaatgattctcacaacgtgttatattaatatgaaatatgtttattgaaaaaaagacatattgcagtattaaattccttaatgccaatattaatcgacataatcaattgtagtggagggggaggattgagttttttccaaaaaaacatattgcagtattaaatctcttaatgccaatattaatcgatataatcaattgaagttagtgggaggattgagtttttttccaaaaaacatcaatagttcttatataataaaaaactaaaataaccaatcatttcaattgattgtgttttatttaaataggaaatgtctcttttactgcacctatggatgcaactagcattcttgaatacacgatatatactttctatcaagccagttatcgataatctcttaagtcagatatgaattacagatgactacgatgtgactagatagaaaggagccaatatgatggtaagagctacttgttgttgcatttatggagtctgtgggactcgcgattatagtctgttcatcgattatgtgtacaagtcgattccagcacatgaaatgtatttattgcagcagatagaactttgcccagaccagatattacatgcttggaaaattagccagaaccctcaggtttccgaagtgtttgaaatagaagttgtttcctctgaagaagatgctgaagaagcggtcttattttggaaagcatattttagttcacttggcgaaacggtcattgatggcaggcatgtaggtgatacatttagccgattttaatgaaagtggcactcacgaggtgtagacttaaaaataatctatcagattgacaatggagatatgaataaaaaccatatttgatatgtatattttaaataatcgtctttaattaaaggttaattcaatttaagtttatgatatgtgaattatcgtgtgtaaacctgaggtgtaaaacacacctctaaaattaatgggtgttaatcccgtgagatatataagtaaaaaatcagataccaaacgatttttatgggctatatttaaatatgaaaaatactgaattaaattttttaaaaacgaattttttatttaaccaagatattactaatgaattgaatacatcatttggacaagatatcattaaaaaaatgataccgcatcgtgaaccatttttaatggtcgacaacgtagagctgatcaatattgaatgcaggttaataaaagcaataagaagagttgacgaaaaagacccggtatttggtggtcatttccccaatgaccctatatatccaggtgtattgcaacaagaaagtatgtttcaaaccgcgcttattttaatgtattttctgctaaatgaaacggctattccgccagcagaggagaatatcatccacgcagtgggaacacgagtatacgatgtctttcacttgtccgcagtacgcccaggagaattaatgacaatccgttgttgtattacagaatacgacacatttcttgccaccgccattgttcaaatcacggttaacgatcagatcgtaaccgtcggaaaaggagagtttcatgtcttctgatcgtatcgttatcactggcgttgccattaatactcccattggtgacacattagatctagtgggtaataatttattatctggaaaatcagccatcggctactggcgcaactttgacaccagtaacatttattcaaaaattggaggtcagattcctgattatgacattgaaggcaagttacacgcatttagcaaccgtattcccgatatagttctttcccgtgccgagaaggtttttaaacagacgaccaaaggtgtccagctatcggtgttgatggccatggaggcttggctcgacgccggattattcgaacacattatagacccattcgattgcgggataatttgtggaggccataacctttctgataaatatttacttgatcagcagaagattttttctgatgagccagaatttattgatgctttttccgggttaaattcacttgatacagaccattcatcttctgtggctcaagtattaaataccaaaggatttgcctatcttgttggcggtacctgtgcgacaggaaatattgctattcagacggcaataaatgcaattaaagtagataaaaaacaggtggttgctgttgtttgcccaatggcatctttccacccgatgatgttgcattcgctaacaattttagaagcgatctgttatagccagtatcaagatacccccaccaaagccagtcgcccctatgacataaatcggagtggtttcctcccatctgagggcggtgccgtcttgatccttgagcaggccgaacatgcaaaaaaccgtggagccaaaatctatgctgaacttctcggtgccagcgttaactcggatgccaaccatcttggcgatccctctcacgaagggcaagttcgagtgattcaagatgtcctaaagaaatgcaatatctccccagagcaagttgattatgtgagcgcccatgccacctccactaaattaggcgatattgtagaactgaaatcaattaaaagagtgtttggctcgcatgcggaaaaactgattatcaatgcgcctaaatccttacttgggcatacgatgtgggcatctggtgtcgtggaggcggcgatagccatttggcaaatgaggcagggtgagtttcatcaatcacataatatcgaaacccttgatcccgcagtcgaactcaatgtttgtgcatccggaaatataaaaaaagaagttaatatttttctgaacaattcttttggcatgggcggtattaacagcgctagcttatttagtcgatatcatggttaacatgaacctttttattagcggtggtgccagtggcattggacgaagtgtggtcattgctgctttgagcaaaggctggaatgttggctttagttatcacaataacaaggaaggtgcacaacagttgcttgatatcgcggtagcggagtttcctcggcaattatgtcgtgcctatcaactcgacgttattgatagtggtgcagtagagtacgtgggagaccgtcttctcgtcgattttagtaacattgatgcggttgtttgcaatgctggcatagatttaccgggcaatttggtgtcgatgaccgatgaagattgggccttggtacttaatactaatttaactggcaccttctatcttattcgttattttttgcctctatttcttgctaataaatatgggcgcattgtcactctatcttcactcgctaaagatgggtcatcaggacaagcggcttatgctgcatcaaaagctggtttggtggggttaactaaaacaacagcgaaggaatatggacatttcggtattacggccaatgtcgttgtcccaggcttaattaataccgaaattattggtgatgacattaagggtattaagaatttttttgctcaatatgcgccagtgggaaggctgggctcccccagtgaagtcgctgaggtcattttatttcttgttgctaaagaaagtagttatgtaaacggtgcggttttcaatgtgaccggtggcattgactgggtttattaactttgggataccttaatgaatagtattggtattgaaaaaatcagtatctacccaagtagtttggcgctgaaattatctgaattggcacaagcacgtggtggggacaataaatacattcaagaatctttaatggtcataaagcgcagtttggtaccacagtgggaagatgcggtcacccttgccgtcaatagtgccaaggatatgcttaacgatcaggatcgttcggatatcggtttatttatcattgcaacagaatcaggtttagaccaagaaaaggccatcagtacttgggcgcatcgttatttaggattacctgcgacttgccgtgtttttgaactgaaatctgcctgccatgctggtgctgcggcattaaagatggctgagtcatggatatcgtccggccttaatcgagggaaaaaggtattactgatcaacgtggatatcagtaataatatgatttgccacgggaagatggaatatagccttggtgctggggccattgctttacttatctcagataatcccgtttttgccgttattgaaacagggaaatcgggtattcatactcatgaagtgacggatgttattcgcccacttccctggaaagaggtcgctttcgatgtagaagccagccttttctcttatatggatggactcgagaatgctttcgaggaatattgtcatcagacaccggaggccagagaaagtacctatttcaattataacttataccatgtccctttccctggcattagtaaagaagcacataaagtattattagaactacaaggactctttggaaaagaggcgctagccacttcatttaagcaaaaagtcatgccatccctgtattacgcgcaaaaaataggcgcgacctattgtggcagcattttcctttccctattttcacttatggtgaaagcaccagagattaaatcaggggatcgaataggggtctactcttatggttcaggatcctgtgccgagtatttcagcatgcaggtcggggaccaggcagtagagattgcacaacagcaaggtgcagcgttggacatactgcttacccagcggaaaatactggatgtggcggcatacgagcaactggaaaatgcacgtagcgcacaaatgcaaggtaaagactatcgtttagacggggacaacttacaggactggtatacacaccattacagcgggagtgggctccttattcttgagcgtatcgataaccacttacggcgttatcgctatgcatgaatatgtcactgtacctatcaaatttagccccgattcattagccgatttcgaaaatcgctttatctctgcgctaaatgacgagcgctataaagtcattgtacttatcggagggcctacctactttagtatgggtatggatcttacgtatatttctacccattatgacgccgacttcgtgtcgcaattctgccatattctaaaaatggtaaggaacagccacaagcccgtattagcgaaggttgaagggaatgttatcgctggggggcttgccttactgtcggttgtcgattttattctgtctagcgatagcgcgtcctttagtttgccagaagtcacctttggaattacaccaacaatagccatgtcttgcttacttgaacgtattaggcctcatcatcttaaatacttcgtatggagctcaagtgttatttcggcaaaacaagccctaaaatggggtttgatcgatcagataaatacactggaaaacttagatcaagatattcaagttataagtaataagctatctcgcattccaaaatccgctataagagaaagtaaattactgttggctgaacaatattctttcgaagaaagtttggatttaggtagccatcttctggtggagagactaaatgatgctcagaccatagaaaagatacgtcactacttagaagacattaagttatttaatgatgaatatgcggatgactaatatgaaaaaaatttatttaagaaaaagtgatgaaggtattgcttttatgcatattaacgatccagtcaacaaaaatgccattgatgatgagttttgtttacagttacatggtattgtcgacacgataaagcaagacaaaaccatcaaagtgcttattttggttggattgcctgatatattttgtaccggtggaaccgaagcgtttttacaaagcctaatcacacactacaaaactaatattgaacacgagtatgccaatcacctcaaacattttctgaatataccgatcccggttattgcggcgatggaaggcagtgctacaggggggggattagtcttaggtttatatgcagatattttagtcgcggcggaagaaagtcgctatggcatgtcatttatgaacatgggtttcacccctgggatgggttcaactgccatgagtaaggaggcgtttggttattacaccggttttgagatgatggtcaccggtaactatattaggggcagtgagctgaaaggaaaatgttgtttcaactatattttgccccgcgccatggtcatggaaaaggccattgaactggcaacctctattgctgaaaaacctcgccatagtttggaattattaaaaaaatacatgtcaatcgaccggcgtaaaatgctagaggaaacaagcactatcgaggcgtttatgcaccatattgcatttaatcaaagcaatatcgaacaacaaatacaagataattacacgggttagatatgctgaataacttgagtgaaatgaccgtattggtaactggtggcacaaaaggtataggccgagccactgttgaaagctttgtgaaggcgggagcaaaagtatatggcacttatttttggggagataatttagatgaacttgaaaaccatttttctcaatatctcaatcgcccggtgttccttcaggctgatatcagtgatgaggagataaccacacagctaatcgaaaaaattgctcaagaaaataaaaaaattgacattcttattctcaatgctgcgtttgctccccaatttaaagatacctataaatttagggggctgctagatagtattgaacacaattcctggccgctgattacttatatagattgtattaagcagcattttggccaatatcctggttatgtggttgcaattacttcggaaggacatcgtagttgccatataacaggctatgattatgttgcagcatcgaaagcggtactggaaacattaactaaatatattggtgcacgagaaaatatcatcattaactgcatttcgccgggtgtggtagatacggaagcttttgaattggtttttggcaagaaagcacaagcattcattcgaaaatttgatccagattttattgtttcacccgaagcggtaggtaacgtcagtgtggctctttgcagtggattaatggatgccgtgcgtggtcaggtcatcaccgttgataatggcaggatgtttaccgataactttaccaagtggatcgacatgattgagacgaattttattgagaaataatgagggggacttcatcgccattatgaatattgagctgagcgaccacttggtattttcactgtattttgaccaaaaaggtattagtcatgtctaatcccaatagaaatctatttcttggccgttggaaacttgagtcctgtattggtaacagtggaggtatacatatttaccctataggtagggagccgtttggtatgttgatctataccgaacagtacatgatggtgtttatttcatcggtagagagaactcaatttagcacggaggatattcgtgcgatcccgtcagaacagatcgtggcagattttcctaaatttgaaacatattgtggccattatattgttaatcacgatgagaaaatcgttacgcactttattgataacagtaaaatccccaatcaaattggtacccagtttcgccgatattttagttttgagcatgagaaactagttcttaaatccatagatagtctattgcttaatgacgaatcgtggttgtttgagcttgtttggaataaacaggaataagcatgaatttattaattaaccaagcggagataatattatggatagagatcatattgctagcattgtaaaaaaacacattgttaattcaatcgatggtgccaaggaacatgaaattgatttgcaaaaatcaatggcagactatggtgcaagcagtttagacattgtttccgttgtatcaggtgttatgagagagttaaaaataaaaatcccacgtactgagctaaaaaatattaaatctataaacggactgattgatctgtttgtaacgagcagttcagaatcttagacatttctgcactatggcctacggaggggccatattcagaactgaaataggaaagcctgcctgtttgtgtaacacaatcacaataaagagggtgatacatgacatcaaatcatgccattttatttccaggacaaggtgcgcagcgtgcagatatgggcgctccgatatttgatatctacaccaaattagtggcagaggctgaagagatcgctgaatttagtattcgtgatttttttcgggattgtcctgcggatcggtttagcaacaccctttatgttcagccagctttatatacagttaatgctttgtattatcgtcgatatattgatgagtctggggcgttaccattatttttagcgggtcattcgcttggcgaatttaatgcattacatgccgccggtgtattcgactttgaaactggattacgtctggtaaaaaaaagagccttgctaatgtctgaaagccaggggggaggtatggctgctgttcttggtctgaatgctgaagaagtggtcaaaatccttgaggaaaataatctgtttgatctcactatagccaatattaattccgacttgcaaatggtgatatcagggccgattgagagtatcaaacaggcagaagagatattttatgataactatgcgattaaatatgttgtactgagagtgagtggtgcttttcatagtacgatgttaaataccgcggccataaaattcagtgagtatatccaaggtttttcatttttaccgcctcaaataccggttatcgccaatagaacagcctgtccatataccctatcttctgtaataaaaaatctctctgagcatataaatcgacctgtcatgtggcggcaatcggttatatatatgcggacacacggtgtagaaagatttactgagatgggagagacttctttactgctggatatggttaagaatattttgtagtagtaggaatttggggtccaatggtacggaagtgtacgataaggaatgttttcttatggattatctctccttcctgctgcctttggttttgccccaattataccaaaccggcggatcttcgcactatctcttgagtgcggatcttcgcacaatctcttgggtattgtagtccctccggtttttagtaccaccgccaatgagagtctccggccagttttatctcgcttaccgccttcctgcaactcgaatgattttgggtataaactcattgagattggtatagataaatctgtggcgcagataagtgccaaccaggcggtttgatagcaatctgagcactcgattctgagagcattgaattccaatacctgcaaatttttatctcacatccattttttagcctatttttttattcaagaaaattatctatcgataaatcacctttaccgtattcgtggttagctgattgactgcaagaatagataaacctcttgtcatctgctcttgcaataaaatactaaaaataaacatcacatttctgaaaaaaatatttgtaggcgaattcctacaaatcacttcccaaattcctcatttggttttaatcctgtttaattacccctttaataacagtgtgttattacccgtcatgtaagaaacttcttacaaatcatatggatgctatgtattttgaaattgaatttggttgcattctgttacatttaacgcatttgcgttaatcgaataatgtttctagactgcgccatccggtattttattgctctgctcatgcgtgtgagaaatacctgtcagagactgtttcatgccatccaatgaatggatagggttatcgataaatattatttctttactttatacacactgagctaatccgtgggtggtgaatgctgtgccaggtaacgtagattatttttattcattctctctgtggtggatttcctgaattcccttcccttaataaggaacgttgatgtcctcttcaagcttccaaaatgagatacctaaagcacgcattaacatcaaattagacctgcatactggcggggcgcaaaagaaagtcgaactgcctttgaagttgttggtgatgggtgattacagcaacggtcaggagcagcgcccgctgtctgaacgtgaaaaactcaatatcaataaaaacaattttaacagtgtgctggctgaattccaaccgagcctgaaactcgctgtaccggacacgctggccggggataacaccgatacagccgtctccctgaccttcaacgacatgaaagatttcgagccagaaaacgtggcccgtcaaattccgcaactgcgtgccttgctggccatgcgcaacctgctgcgagaccttaaatccaatctgctggacaacgccaccttccgccgtgagctggaaaatatcctcaaagacgatgccttgagcgatgaactgcgcgctgaactggcggccctggcgccaaaagagggttaatcccgggattggctgcttgtcattagaaagaagaaaaggaacatgctgatgtctgtacaggaaaaccgtgcgcagggtactgcgacgaccgtattaaagaatagccctgcggcacaaggggtttacgccgccttgtttgaaaaaatcaacctgagcccggtctcctcactggccggtatcgaggcgttccagaacaacgatgcgctggcggaagccaccaccgatgagcgcgttaccgccgccgtcagtgtctttttagacctgctgaagcagtcggcgaagaaagtagaaaaactggataaaaccctgctggacggccatattgccgcactggatgaccaaatcagccgccagttggacgcggtaatgcaccaccccgatttccagcgggtggaatcgacctggcgtggtgtgaagtcgctgatcgatcagaccgatttccgccagaacgtgcgcatcgagctgctggatatcagtaaagatcatctggtgcaggattttgaagatgccccggaaatctcacaaagcggtttatacgcccagacctatattcaggaatacgacacccccggcggcgagccgattgccgcggctatctccaactacgagttcgaccgcagcccgcaagatatcgccttattgcgcaatatctccaaagtggcggctgcagcccatatgccgtttatcggctcagtgggtccggcgttctttggtaaagagaacatggaagaggtggcggccatcaaagatatcggcaactactttgaccgcgctgaatacatcaaatggaaagctttccgcgactcggatgattcccgctatatcggcctgaccatgccgcgcgtgctggggcgtttgccgtacgggccagacacggtgccagtgcgcagcttcaactacgttgagcaggtgaaagggccagaccacgatcgctatttgtggaccaatgcctcgtttgcctttgccgccaacatggtgaaaagcttcattaaaaatggctggtgcgtacagatccgtgggccacaagccggtggtgcagtcaccaacctgccaatccacctgtatgacttgggtaccggtaatcaagttaaaatcccgtcagaagtgatgatcccggaaacgcgcgaatttgagtttgccaacctgggttttatcccgctgtcgtactacaaaaaccgcgattactcgtgcttcttctcggccaactcagcccagaaaccggcgctgtatgacaccgcggatgccacggccaacagccgcatcaacgcccgtctgccgtatatcttcctgctgtcgcgcattgcccattatctgaaactgatccagcgcgagaacatcggcaccaccaaagatcgccgtctgctggagctggagctgaacaactgggtgcgcgggctggtgacggaaatgactgatccgggtgatgatttgcaggcgtcccatcccctgcgtgatgccaaagtgacggtcgaagatatcgaagacaaccccggcttcttccgcgtcaagctgtatgcggtgccgcatttccaggtggaagggatggacgtcaatctgtcattggtttcccaaatgccaaaggctaaggcataaacggcgacacgatgaaaattgaacgccctctgtgggctcgcgggatcctggtgtctccgcaacaatttcaacaacaggcttcctgggaggcctggaccaatgaatgcattgcgcaaatggccgtgatgcatccctggggcgtgcttcaggccacttttgaattggatgcattggcacagggccgcctgaaagcggcgcgtttgcatgtgcgttttcaggacggtgtgctggtggataccgagtgtgctgatgtgctgccgcccacgctgacgctggcagccagtctgcccgccgaggccagcgacgccacggtgatgctggcgataccacaactgtatgccaatggcggtaactgcctgcagccggatgagcggggcgaacgcccggtacgccatcgtcaggcctggcgcgatgtccaaaatcagttcggcgatgacaaaaagcaggtcgcggtgatgtaccaccaactgaccctgcggctggacactcaggaaaacggcgattatcaggtctgcccggtggcgcgtttgctgcgggatgcgcaaggtcgctggacactggatccgggctttattccgccgatgctgagcctgcaggccagtgcctggtgtggcgaacagcttgagttattgatggtgcaactgcgggcgcgtttgcagcgtctgatggggatgcgccgggagagcaatgcacggatggccgattttgctgtcgcggatgtgtcgctgttctggctgctcaatgcccttaacagtgccgaaccggtattggggaattttcagcgctatccgcaggttcatccagagcgcctgtatcaggaactggccaggctggcgggcagcctgctgacgttctcccttgaacacgaagtgacggcgatcccggtttatcagcatgaacagctgacccgcgtctttcccccgttgtttgccctgctgaatattctgctggaagccagcctcccatcacgggtggtggcgattgagctggttcatgaaccgcgcatcaatcagtggcgcgcgaccctgcgtgaccctcgtctgcgcgaaggggccgatttctacctgtcggtccgttcctcgttgcccgcggcccaattgcagactcagttcccgcagttgtgtaaagccggtgcgccggatgaggtcggtaacgtggtgaatgttgcgctgagtggcatcccactgcgtccgctcagccatgtcccagccgccatccccttgcggctggaaaaccagtacttctcccttgatctcagccaccctgcggcgacgcagatgatggagacgggggcctgtgtgttctatgtacccggtacgctgggtgagatccaactggagctgtttgcggtgctacgcgcatgaatcctcacctaaccgaacaccccccagtcggggatattgacgccctgttacaggacacctggctacaggtgatcagcctgcgtcaaggggtaacctgtgccgagggcgaagggcaggcattctggcagcgctgtgtggcggacattgaacgtgtccatcaggcgctgaaagacgccggtcacagcgagcagagttgccagcacatccgatacgcccaatgtgcactgctggatgaaactgtgaaagggcgcggtgtacaggatgatgcctacttcgtgtggtgccattcgcccttacaggcgcattttttcaataccctggatgccggtagccagctttacgagcggatgcgcgccgtgttgcgtgagcctgcgccggatcgcgcggtactgacctgttttcaccgggtattaatgttgggcttcctcggcgggtacgcctccccggcggcttctgaacgggagcaactgatcgatcaactgagcgtgcaggtaccggcgttcagtgtcgcgccatccggtgggatcctggcaagcgccgcctcccgcaaccggttggggatctggctgcgttactggccggtacggctcgggctggctgcgctgatggtcgcgctgttgtggtggggccttgatcactggctgtccggtctgttaaccaccttactgccggagccggtgtaatgagtcggtggtggcaacgtgggttgtggctctgggcgggtttgctggcggtcatcttgtgtctggcatttctgccgctctccccgtgggggcgctggctgatgctggcatgggtggtgctgatttgcatgttgggcgggtcgcgggcagggcggcaagcggccggtgcatcctctgatccgctgttcgccgggttggcaactgaaaacggtcttctgcctgaaaacagtcgcttaccggtggtgttggtatgtggtgatggtctggcgtcatggtttggtcgcgaacggtcacaccagagtgcacagggctgctggctgcgggtggatgatatcagcaccctgcggcagtttgcccgacaactgctgtggcaacggccggaatgggccgctcagttggcggtgatgatggtcgtgaacccgcagcaacgccgcgatgagcgcctgctggccgccgatctgcaagagctgcgctggcaactgatgcaactgcgccgcgatagccgccatccagttcccttgctcctgagcagcacggtggccacctcggttgcccgtgatacggtctggctgtcacagcagcagacaccgccgctgacactctggtcaaccgtctcgacgccgggctctctggccgactggcagcgtgcggaaagccgtgccgtacaggctgaacgactgaaacaggcggtgctgttcagcagccagcatgactggctgaacgcacaggtgctgccggtattgcaggcacccaatgcggatgttgccccccttgccccgcaacagattattcaacagcaggttgccagtctggccgatccggtgcctgcctcgctgtggcagcactggctggcggcgcataccacgctgacacaggtggcgggttggcatccaccgccgcccgccgcccatgacgccttaccgctgccggattttgtcttttcagcgcttcctcttggtagcggggtgtcgtcacgccgtcgggtactgcgccatggtgtcaccttactgacgttggcggcgatggtggcgttgtgcagcagcgcctggcagaaccggcaactgttgcaccgggtggcctttgatatccgtcagtaccacagcgtggcgatgacggattattccccgaaagcgcaggcggtggcggtattacgccgtgatgcggggctgcttgatgaagggtaccgcaacggtgaaccgctgcgtctgggcctggggttatatcggggggagcggctgcgcccgccgctgttggcggcgatcaaaagctacatcccgccccctccgccccctcccgcgccaccggcgccgaaaaccgtgcgcctcgacagcctgtcactgttcgatgtgggtaaattcacgctgaatgcggggtccaccaaaatgctggtcacggcgctgatcgacatcaaagccaaacccggctggctgatcgtggtggccgggcataccgacatcaccggcgatgcgcaggccaaccacattctgtcgcttaagcgcgccgaagcattacgcgactggatgctgtcaaccagcgacgtctcgccgacctgctttgcggtgcaaggttacggggccacacgccctatcgccgacaacgatactcccgacggtcgggcgctcaaccgccgggtcgaaatcagtctggtaccacaggctgatgcctgtcaggtgccggatgtaaaaacagcgtcacaggatgaaagtgacgtatcaacgcaagaaatggagaagtaaaccatggcaattccagtttatctgtggctgaaagacgacggcggtgcggacatcaagggttctgttgatgtgcaaagccgtgaaggcagcattgagatcgtggcacaggaccataacctgtacatcccaaccgataacaataccggcaaactgaccggtacccgtatccacaccccgttcgttttcaccaaagaaatcgatgcgtcgaccccgtacctgtacaaagcggtgaccaccggtcagacactgaaaaccgccgagttcaaatggtaccgcattgatgacgctggccaggaagttgaatatttcaacaccaaactggaaaacgtcaaagtggttaaagttgcgccgaaaatgcacgacgtgaaagatccggcgaaagagaagcacaaccacctggaactggtggaactgcgctacgaaaaaatcacctggacctttaaagacggcaacatcattcattccgattcgtggaacgagcgcgccaccgcatagtgacccgtcattcttcgcgccgcaggtgcgttggcgatattgccgactgcctgcaacacgaattatttagggtaacggctggcaacgttaaatgaaggggaaacgtgccgttggggtcgctcttagtttcaaacacaagtgcgtaagccaccggagcgccccgaggtgcggtcaacccttcactcactgaacgttgtcatcaacctcaggcggttcgccgcctgcttttttgtgttttttattttttctcagtgactgtttgtgcggtgattgagcaaaaattcacaaccctttaatgaccttatgggccttggtttccttagtaaaggaaaggctacgggcggtagcgtgtccaaatagggtaaatggcaaacaaggaagatcttaatgacaacgcattcagcacacttattacgtcggttaaatccctattgcgcacaggcactggccggtgccgccaccctgtgtcagacccgcgcccatgctgagatcactgtcgaacactggttgttaaaattgctggagcagggcgaaggcgatattacagtcattgcccggcgttatgagtgggacatggacagcctgtggcagggattactggcccatctggacaccttgccgcgcacggtacagggcaaacctcagttgtccgccgcgttacagcaactgatcaaaaacgcctggctagatgcctcgttgcaggaagatgccgatgcggtgcgttccgttcatctgttatctgctctgataaattcgccatcattactggccgccgatgccgcctggccgttgctcagcctgagtaccacccagttacaccgcctgttaccgctactggacagccaatcagacgaacgccctgaagttcagcaggcagcggcactggcagacagcccggtcaatctgaccaatgaggcagcgactactacctctgccagcggccagccgcaactcaatgacgccctgcaagcggcgctggataaatttacgttggacgtcaccgccaaagcgaaaaccgggcagattgacccgatttttggtcgcgacagcgagatccgccagatggtcgatatcctgtcgcgccgccgtaaaaataacccgattctggtcggtgaaccgggtgtgggtaaaaccgccttggttgaagggctggcactgcgtattgccgagggcaacgtaccggacagcttaaaaaccgtcagtgtgcgcactctggacttgggcctgttgcaagccggggctggggtcaaaggtgagttcgaacagcggctgaaaaatgttatcgaggcggtacaacaatcaccgacgccggtgctgctgtttatcgacgaagcccacaccatcatcggtgccggtaatcaggccggtggcgcagatgcggccaacctgctgaaaccggcactggcgcgtggcgagttgcgcaccatcgccgccaccacctggtccgaatacaaacagtattttgaacgcgatgccgcactggagcgccgcttccagatggtcaaagtggacgagccggatgatgacaccgcctgcctgatgctgcgtggcctgaaagaacgttacgccacccatcacggcgtgcatattctggacgccgctatcaccgcagcggttaccctgtcgcgccgctttctgaccggtcgccaactgccggacaaagcggtggatcttctcgacaccgcaggtgcgcgcgtgcgcatgagcatcgacaccttgccgactgcgttgatggagattaacgccgaactggccgcactggcgatggagcaacaggccatcgaacaggacttgctcctgctgccgaatgtcagttcaacgcgcttacctgagattgagcaacgccgcgccgcgctggcggttgggcagcaaacactcgaacagcaatataaagaagagaagcggttgaccaccctgattattgaggcgcgtcaggacatcgccaacgcagcacatctggtcgcgttgcaggaggaactcgttcagattcagggcaatgcgccgctgttgtcgctggacgttgatgtgcgcactgttgcggctgtgatcgccgactggaccggtgtgccgctgggcagtttactcaaagacgaacaaaccaacttgctgtcactggaaaatcgtctgggcgagcgagtaattgggcaggatgcggcattaggcgcgctggcgcaacggctgcgggcggcgaaaaccggcctgacatcagagaatggtccgctgggggtgttcctgctggtcgggccgagtgggatcggcaaaaccgaaaccgcgctggcactggccgacagcctgttcggcggggaaaaatcgctgattaccatcaacttatcggagtatcaggaagcacacaccgtctcccaattgaaagggtcgcccccgggctatgtcggttacggacagggcggcgtattgaccgaagcggtgcgcaaacggccttacagcgtggtgctgctggatgaagtcgagaaggcccatcgtgatgtgctgaacctgttctatcaggtgtttgaccgcggttttatgcgcgacggtgaagggcgcgaaattgatttccgcaacacggtgatagtgatgaccgccaatctgggcagtgatcatctgatgcagttgctggatgagcaaccggacgcgccggacagcaccctgcatgaactgctgcggccaatattgcgcgaccacttccagcccgcgctgctggcccgcttccagacgctgatctaccgcccactgaatgcccccgcgctgcgcaccatcgtcgaaatgaaactggcacaggtcgctaaccgcctcaaaaaacattacggcctgcactgcactcttgaagcaagcctgtacgacacactggtcgccgcctgcctgctgccggacaccggcgcacgcaacatcgacagcctgctcaatcagcagattttaccggtattgagccagcagctgttaagccgcatgagcgagcaacagcgcaccacctcgctgacgctgggctgggatgaagccgacggcattacccttgaatttgaaggaggcgaaaaatgaataccactctcccgactcttcggtttgaccatagccaccacaaactggtggtccgcgacagcaccgccgccgttgatgtgctgggctttgaaggccacgaaagcctgagccagccgttctgttacgacatccaattcaccagcgccgacaaggcgattgacccggccactatgctgatgcaggacgcgtcactgacattggcggccccggtggccgaagcttttggcgtgacggttcagcagacccagcgggtgatccacggggtggtgaccggatttaaacgcctgtcggcctcgaaagaggaatgccgctacgaactgagcctgcaaccgcgcctggccttgttgtcgcgcagccatcagaacgggatatatcaggacatgtcggtgccgcagattgtggaaaaaattctgcgtgagcgccatgacatgcgcggtcaggattttgtcttcacgctggcccgcgagtacccacgccgcgagcaggtaatgcaatacggcgaggatgacctgacctttatccgccgcctgctggccgaggtggggatctggtttcgttttaccgccgatcccaaactcaatattgatgtggtggagttttacgacgaccagcgcttctatcagcaaggactgacgctacaggcggtgccgccttcggggatgcacgacagcgggatggaatcggtctgggatttgtccagcgcccatcaggtggtggaaaaatcggtcagtaccggtgattacaactaccgcaccgccactgccgatatgaccgccggggccgacatcacgcgcggtgataccaccacctacggcgaagcttatcattacgccgataactacctgaccgcaggcagtgaagggcgcgagccggaaagtgaaagcggggccttttatgcccgtctgcgccatgaacgttacctcaataatcaggcgcgcttcgccggggtggccaatgcggcggcactggcaccgggtcaggaactgaacgtcaccggcaacgacgtgccagcacagtttggcaaaggggtgatagtcacccgcatcaccagccacgcccgccgcgaccgcagctatgaagtgcattttgaggccatcccttactccgaagagtattgcttccgcccgatcctcatcaacaagccaaaaatggccggcaccttgcccgcacgggtcaccagcaccacggtgaacgacacttacggacacatcgacaaagacggccgctaccgtgtcaatctgatgtttgaccgggacagttgggagccgggttacgaaagcttgtgggtccgtcaggcccgcccgtatgcgggtgacagctacggcctgcacctgccgctgctggcaggcaccgaagtggcgatcgcgtttgaagacggcaacccggaccggccgtatatcgcctatgtgctgcacgactcggcgcacggcgaccatgtcaccatcagcaactacaaacgcaacgtactgcgtactccgtcgaataacaaactgcgccttgaggatgaacggggtaaagagcacatcaagctcagcaccgaatatggcggcaaaagccaactgaatctggggcatttggttgataacgagaaacagcctcggggtgagggttttgagctgcgcaccgacagttttggtgtattacgggcagaaaaaggcctctttatcactgccgacggacaggccaaagcacaggggcaggtgctggagatgcaaccggctatcagcctgttgaaaagtgcgcaggaacagatggaggccatctccgcggatgcacaaaccgccaccgccagtccggccaacctacaggtacaaatcagtctgttgcagcaaaatctcactgaactgaaacaagctgtcctgttactgagtgcgccaaaggggatcgcgttgagcagtggcgaacatttacaactgtcggccagcgaaaatctgatagccactgccggtaagaatgcggatgtcagtgtaggtaagaatttttttatcggtgtgggcaacacgctgagcgtatttgtacgcaagctggggataaagttgatagcgaatcagggagcaataacggtacaggcccagaatgatctgatggagttattggcgcgtaaagcgatcacgatcaccagcaccgaggatgagataaaaatcaccgccaagaagaagataacgctaaatgcaggcggcagttatatcacgctggatgagaatcggatcgagtcaggaacggcgggggaatatttgaccaaagcagggtattacgggcgacaggaaaaagcgaagcaggtagtggcaatgccagaatttcagctgattcccggtgggaagcataatctacaatttctatttaccgatgatgataatgtaccttattcaaatacaccgtatattgcttatcttgtcgatggaagagaaattaaaggagtgacagatgcaaaaggtaatacggaaaaatttgttaccgatgaagagcaaaatataaaaataaatttacaggtatagtgttcttaaaatgtaaaaatgcattttttgagcgtttctaaaaaccacttgatctttttaattttcaacttaaattgatagtgaattaagtgtaattattgtttttgtggaggctagatgtcggttcatattgttcagactaaaataaaatctaatgtatcatatgatgagctttcttatagtttctcgctatataaggatgtttatggaaaacgaatttatgttttacctgataccggtataaaaccattagcagcagactatagaacacaagaacataaaactattgatataacagaagaacagtccacagtttatattatggaggtcatgctttaccgtaaaacgacaaccggtgataaacctgtgttactaaggcctgcaacatcgatttattcatttggtaaatttaatggtgataattcctcccgtgaaaatgtttgttattatgaaacattaaaatcaactaaagaacagcgggaaggggacggcaatattgcccaccatcttattacccgtaaaaaagatagtgtatttgagtcacctcagcatcctaaaactgacgaagtaaacaatccatttaaaaaaagtgatatagaggcggccttgaatcagagaaaatatgggtcatctaatagggcgataggtgatttttatcccaatcaaaaaagaacaatgttatgtggtcctgctgccttcacttattgtttgatgatggatagatttgatttatatcaacaggcaatatgggatttatgggaaactggtaaaacaagaattggttcattagttattacagcttccgatgaagttaagaaaccggtggatttgtttggacttgattataatggtatcgaagaaattaaaatacctgctattgattggatttttatggctagtttaagagactcctcaaataactttatgaattacaataaggttagtgatgcagcatctgcaattacaatgtggggtgtgatgagagaatggttttccgctgttggtgcaaaaaatacttttagtaacattagcctctctcatagtaatttaacagatatttctgctcttaatgattttgtagacacggttaattattctacacatatcgttgcactggtaagtgcaaagatgatggggggagctgatacttcatttaaagaccattgggtagtatgggaaagtggtttagagacaacaaaaattacacaaactgatgttacaaaattaccaagtactattgtttcgaaaaatactagtgttaatgaaaatgtaatgctaaaactatttacatggggtgaagtgcgaacaaatagacttaataaagatctaacattagatgattttttaaattgttcatttgggggggtggtatttgcaaaaataccataaattattatgggtaaatttttaagaatattttcaatacttgtgtttgcgatttttttgggtggttgtggaatgatgcttaatcctcttcttatgaagcaggccgaagttgaaccacctaacttacctgaaggtaaattagggcaaccctactacgctaaacttaaaataacgggtggtagcggcgctattgcttcttttaagggggattccatacccgttgagtcagggttggtattaacgttggatgatcctgaacagccgcctggtagagatgatctgattataaaagggattcctttagtctctggtgaggttatatttagagtgagtgggtcattatttggtagcgcggataaaggttactttggtaaagaatataaagtaaaaatagttgagtgatatgagtgttgattttaagggtgtattaagtgttttttttatttagcattcgatatgggtgtgtaaaccgtaattattaactaaattaaatgctaaataccattatttaattaatgcctgctaaatgttatatttcccatgattggtgtttggtgtgtgtcgagtttttctaaaggtcggaggctaagtattaatagtgacgaatgtcagaggcggttagggattgtaggggttggtaataagattaatatctaaattgaaaagtatattatttaaagataaatcagcaggtatctacaatacaggcgaataaaaatgaatacctctctccccgctattcggtttgaccatagccatcacaaactggtggtccgcgacagcacggctcccgtcgatgtgctgggttttgaaggccacgaaagcttaagtcagccgttctgttacgacattcaatttaccagcgcagacaaggcgattgacccggccacgatgctgatgcaggacgcgtcactgacattggcggccccggtggccgaagcctttggcgtgacggttcagcagacccagcgggtgatccacggcgtggtgaccggatttaaacgcctgtctgcttcaaaagatgaatgccgttacgaactgagcctgcaaccgcgtttggctttgttgtcgcgtagccatcagaacgggatttatcaggacatgtcggtgccgcagattgtggaaaaaattctgcgtgagcgccatgacatgcgcggtcaggattttgtcttcacgctggcccgcgagtacccccgccgtgagcaggtgatgcagtacggcgaagatgacctgacctttatcagccgcctgctggcggatgtggggctctggtttcgttttaccgctgaccccaaactcaatattgatgtggtggagttttacgacgaccaacgtttttacccgccagggctgacgctacaagcggtgccaccttcggggatgcacgacagcggcgtggagtcggtctgggacttgtccagtgctcatcaggtggttgaaaaatctgtcagtaccggcgattacaactaccgcaccgccactgccgatatgacggccggggcagacatcactcgcggtgataccaccacctacggcgaagcttatcattacgccgataactacctgatcgcaggcagcgaagagcgtgagccggaaagtgaaagtggggcgttttatgcccgcctgcgccatgaacgttacctgaacaatcaggcgcgcttttcgggggtagccaatgcggcgacactggggccgagtcaggaactgaaagtcaccggaaacgatgtgccggcacagtttggtaaaggggtgataatcatccgcatcaccagctatgcccgccgtgaccgcagctatgaagtgcattttgaggctatcccttactccgaagattattgcttccgtccagcacttatccgcaagccgaccatggccgggaccttgccggcgcgggtgaccagtaccactgcgaacgacacctatggtcatatcgacaaagacgggcgttaccgtgtcaatctgatgttcgaccgtgacagttgggagccgggttacgaaagcctttgggttcgtcaggcccgcccgtatgcgggtgacacctacggcctgcacctgccactgctggcgggcaccgaagtggcgattgcgtttgaggatggcaacccggaccggccctatattgcttatgtgttgcacgactcggcgcacggcgaccatgtcaccatcagtaattacaaacgcaacgtacttcgcactccgtcgaataacaaactgcgccttgaagatgaacggggcaaagagcacatcaagctcagcaccgaatacggcggcaaaagccagttgaatctggggcatttggttgataacgagaaacagccacggggtgaaggttttgagctgcgtaccgacagttttggtgcattgcgtgcagaaaagggcctctttatcagtgccgacggtcaggccaaagcccaggggcaggtgctggagatgcaaccggctattagcctgttgcaaggtgctcaggaacagatggatgccatctccgcggatgcacaaaccgccaccgccagtccggccgacctgcaggcacaaatcagtttgttgcagcaaaatctgagtgagctgaaacaagccgtggtattgctgagtgcgccaaaaggcattgccttgagcagtggtgagcatctgcaaatgtccgccagcgaaaatctgatagccactgccggtaagaataccgacatcagcgtagcaaagaacttatttattggtgtgggaaataccttaagtatcttcgtcagaaaactggggatgaagctgatagccaatcaggggccgataacagtccaggcgcagaatgatctgatggagttattggcgcgcaaggcgataacgatcaccagtaccgagaatgagataaaaatcaccgccaagaagaggattacgctgaatgcgggcggcagttatatcacgctggatgagaatcggattgagtcaggcacggctggtgaatatataaccaaagcagggcattacgagcggcaggaaaaggcgagtttaaaatctataatacctgcttttcctattattgaaccgggagaacatagtttacggtttgcattctatggtgacgataatgttattgggtctatgggacatcttgtcgggcagccttacaatatccgtaatagcgctggtgaagttatagcttcaggagtattggatcaatctggccgtttcccaagagtaaaaactcaagaagcggatgagttaacgctgactttaggtgaggaaaaatggacagtagaagagcttatagcgtcaacagaagatcctatcggtgaggagtttagcgaacctgatgaatacgatgtagatagtgatccttatttcgaaaatatcgctcaagaacaacaaagtaatagattgcctgatacaataattaataaatttattggctatgtagaagaggatatctagtattgaaaacgtatatttacaaatttattttgagtttagtattgattgtaccttccttacttattcatgctgcatgtttaaacgaaggtgatgcggtaaagttatccggtagcttgaaaaaagaagttttttttggccctccaggctggggagaggatcccaaaaatgataagaagctaacttactggattttacatcttgataatccattaacatgtgtcatagaggcaaatgatacccaagaaggatggggaaatgatgtccaacttattcttgaaaataatgagtatgaggattatcgccagtttcttgaaaaacaggtcagtgtaagcggtcgtatctttctggcccagactgggtaccatatgacacctgttctgttggatgatatttcatcagtttcgcgaactaatcaatagtggaaaaaatgaaaccagttaaatttataacggctactaaccatcagaataaaaagactgtcgaatatgaagccgatgatggttcaattttattaaaaattggtggggatctaagctggcgctttaataacccaggaaatcttatcgcttccaaagatatatcaaagcagcctggtagaattggcattggcacagttaataatcctaataagcatgattttgctatttttgctagttacaaggatggtattaatgcaaaaaaattattattaaaaggtaagtacgggagttctacgatcgatgaaatgatagcgaaatatgcacccaaaagtgatgggaatgaccctaaaggatatgcagatcatataattaattatagtggcgcgtcacgaacacaaaaaattagtgacatggataatgctacttttgaaaaggtgatgcaggcaattcagaaaaaagaggggagtggaaaagaagggaaagaagaatggataaagacaactaaaattaccctatctgatggtacaaaacccgtagtgggttatccactgaaagtgacgcttggtacttgtacctatgagtggttaaccaataattatggcgagcttcctcttattgcgcatcttaatgatgggatgaggattgaggtaaagtcgagtagcccatcaggcaaagaagaggttatttatgcagctacaggactcgagtcaaagagaatagtactgaaaaaaaaatcaacccaatatactgctcatactttacctgaacagccaaagaaacccagagaaaaaagcaagccgaaacctattgagtatattgtagagtcaaaagatactctatcaaaaattgcaagtcgttttaatgtaagtatttccgatatttccaagaataataatataaaaaatattaataaaatatacccaggtaaagtgctaattatatatggcaatgctgataaaggtattgacttaagcgagcaacagccttgggaagaaaagggaatgtcgttcccagtacctccatatccttcaaaaaaagatatcgaactaaagaggactcctaaatcagaagttaagccaaaagtagaaacgcaatccaaaccagaagctaaacccaaaccagctgcccagaagtcacaaaaacttgctacggtaggtggaaaaaatagtgggaatgggcaggcacatatacctttactccagaacgaagctccttggatggtagttgcagttaaagaagctgaaaaatgggggggggttgatgagtctgtcataggtgataatttccataaattattaagtgctaatacgaaaagaacattatctaatacgccatggtgcgcttcatttgtaaattattgtttttattcaactaattataaaacctcacataattacgcaggatcaaattcttttgcagataaggatgtgaattttaaaaaaataaaaaaatctgtttttggctgtttaatgatttggcaaaaatcgggtaatggtcatgttgcttttgtttatgggaaagatagtgtgaccgatcaaattattgtattaggtggtaaccaggatgattctataaacttcatgcttgaatctgacacaacaaagaattttgttggctactatgttcctgccatttacaacccagactttgaaaagaagttagatgagtatgatattgttgagttaaacaaagagtttggtataacctatgccagaaaatccaaaggtaaagttaaaaaaccagttaaggatcgttaatgatatgaaatcattcaaactaataatgtttttttttattttattatctagtttttctggatattcaggtgaacgcggatattttgtttttgtatggggagatgatataagtaaaaaaacgtttatcgaatatcgtgaaaatagtaatgagtatataaaaaataaagaatgttgggctaaaagatatggggacgggatatcaatagcctatgttaatttagttccaaatggaattaatatagagttagtgaatcgagcattgtctggagatgcgagttctatttcccaaatacaatatatacttaaaaactatagagatgaccagataacgcatggttttgatggtatgcttattatgaaagaaaataataacatgatgagtgttttatccataccattatatggaagtttaaataaagttcaacaggaatataaggctaatataaataaatacgaattcatagataaactattatgtgaatcactttcaccatttgatcgtcactttatcccatgattattttacttatttaactatataagggagtcaatgtaaggtgtagatcttttgggggtgataagtaaactataatgaagggtgtatgttgagtcgtattttatttttaagtatattaccatgctctttttctagtgcgcaggcagagttgagttgtaaactaggccctgctggttgtaacactattaaagtgttgttaatatcaaaaaatagaggcataacagattggtttttatttaaatgataatttaatttcctcgcttaaaaaatgatgtaagtgaggctttcgtttattatgatttaccacatcaaaaaataaatctaaagtcattggaaagctattaattacatatgatggcaaagattgcgtttcagataatacaatttttcgatgtgctaagtttagaattgttgatcttaatgacccattagtaatatctgatttattttatcctccagtgttaaattctatactaatgcacgtttcatggggaacagataaatctatcatgagttttgaggataaatctgaattcacatatcagaatgggcatgtgaccatgacgaatggtggcgtgatggctcagcaggaaaaaataaatcaatccaaagggaagtgactgttcagtaccttaatataaaccttggttaatatatgacaagtatgggttaaatcatctaactatctgcgtgttatcacactgtatgtgccaaacaccagactaattacatcatgacagaatgctttcctcttcgttatttaatattcgagtcctcttatgcccgtaaaattaaccaccattcccggcccgtttttacgtccttcgccgcccaagccattacgctggctgattgtactgctggggtttattgccgcaggaatattactgatgcgttttctggggaaactactgggcgataccgagttctggtggtttgccatcggtatcccggtggttttctggctggttctcatgggctttcgtctggcgatttatctgatgcaacagatccaggccaatgcctgggattcacggcgtgagcaggtcatattgcaggaggttcgccgggggcggcgggcgttgcaaattctggcggccgcatgcagcacggcgcatgatcctaacctgcaatttaccgggatagcagacgcattactgcgtaatgacaataaaatcattccccagaccgcctggaatggcgggagcagtgttcggcacagccggttgccggtcactgacggcttgtctccggatgcacatttatctgccgtattttctgctctgctggataatctgactgcccccttgtcccagcttccctctgacaatgcggtcgctattttgttggcgtcttcttcttcggtgcccagagcccgggtgctggcactctggcagcaggcctggcaggagagcggtattggtcagccgaccacattgctctcaggccacggactgaccgttatcgatcactggctggatcatcgcattaaagatagtgcggtgttgctggttgtcgccgtgcagatagcccctgaacagcccgaaatgaccggcgaggccgtggtgggtctgttattggcaaaccgcctgacccaaaaaatacttaccccgctggcgctgttacaccgcccggagtgtaccctcccgcagcaagagagcttgcaggcgggggtgttacaggcggctgactgggtgccgttacccccggataccctacaacatctctggctgaccggattatccgtagaaagtgagggctatcgcagtgccatcggtattcagggcaaagcgccactggcctgcatcacacccggtccggatgtgcataattttaatgaatttttaggatgtcctggatgtgcaggtccgtggctggcgatagccgccgccgcgcaggccatcggtcattccccaacaccgcatatgatcctcagtagtgaacaaggcagtgacactgtctggagtaccgtcgtatcccctaatgcttcccgcaaggagaatgaaacgtgaagcgcattgccctaccgattaaaaagccagaagtctggttctggattgttgccctgctgtttttgctggccggtgccgtgttgtgctggctggtctggcaacaccccgaacgggtggggttaattccggggacaccgcaacgtgaccgttggctgacgggactggtggtgggaacggggatcctgaccttgtgcgcattactgtcgtatgcggggacccgtttatccggcagaaaacactttgatgagctacggcagcaggcacagggcgatgatgcgccgttgccggaagacaacgcgcaggcaggagaaacgtcgcagggtgaaccgtcccgcctaaaaacccgcctgcgccgccgttacggtctgttctggcgcgacaaagtccggctgctgatggtggtgggtgaacctgacgaaatcgccgcgctggccccgcaactggcggagcagggctggctggaagggcagcgcacggtgcttattcacggcggcagtttacaacgtccggcggatgaaaccgggctgagcgaatggcgaaaattgcgccgtggccgcccgttggatggcattgtctgggcgatgaccgccgcgcagagtggcacgccacagtggatggataacggcctgcgaacgctggaaaaaatgggtgccgccttgcgctatcaaccgccggtgtatctgtggcaggtctgtgacagcgactggcctcaggattcgcggacggagcagccggtcggggcggtgttcccggcgaaggctacgccagaaaaggtggagcagcaactgcgtgccctgttgcctcagttacgtgaacagggaatgcagcagctttccatcgagccgcaccatgatttcttgttgcgtctggcgcagtcactggatcagggcgatgcggctcgctggcggcagcgtctgacgccgtggtttaccgagtatgccgcgcgtattcccctgcgtgggctgatgttcagtttacccgatacctctgcatcggcggcgcaggtacatgagaaaagctggacggtaccggccagttggcagggggtactggatgattgccgggtggcgcgtggacgccgtgtcgggctgccgtgggagcagacactgtgctacagcttgctggcactgattgtcttgtggggtgtgggcagcgtggtgtcatttacggtcaaccgccaccagatggtctctgccgcacaacaagcacagcaactggcgcagtcgcacgcagtatccgaccagcaactgatggccttacaagccctgcgaaatgatatcgggcgcttacaggcccgcgtggcgcagggcgcgccgtggtatcagcgctttggtctggaccataatgcgccgctgcttgaggtcctgatgccgtggtatggtcaggccaacaaccgtattctcagggatgccaccgcgcagagcctgtatcagaaactcagcgaactggcggagctgcccgccaacagcccgcaacgggcagcacgggcaaaaacaggctatgaccagttaaaggcttatctgatgatggcccgcccggaaaaagccgatgctgtattttatgctcaggtgatgcagaccaccgagcctacacgggccggtgtctcccccggtctgtggcagagtctggcgcccgacttgtggcagttttatgcacaaaatctgcccgctcagccggactggaaaattaccgcggataccgggttgatcagccaggtgcggcaggtgttgctggggcagatgggtcagcgcaatgcagaaagtacgctgtatgaaaacatgctgctgtcggtgcgccgcaactatgccgacatgacgctgatggacatgaccggcgataccgatgctcagcgtctgtttcagacctcggaatccgtgcccggtatgttcacccgcaaggcctgggatgagcaaatccagcaggcgatagataaaacggtggcctcccgccgcgaagaaattgactgggtattgagtgataaccgccgggcgatatccgaagatatctcaccggaagcgctgaaaaaacgcctgaccgaacgttatttcaccgattttgctggcagttggctgagtttccttaacagtttgcactggaatgaggcgcataacctgtcggatgtgattgaccaactgaccttgatgagtgatgtacgccagtcgccgctgattgcgctaatgaacacgctggcgtggcaagggcagaccgggcagcagaatcaggcattatcggattcgctggtgaagtctgccaaggcgctgatgaataaagaccaggctccggcgattgaccagagtgccggtgggccagtagggccactggacgagacctttggcccgttgctggcactgatgggcaaaggcgatgcacaaaacaggctgtcgtcggacagctcgctgagcctgcaaacgttgctcacccgcgtgacccgggtgcggcttaaactccagcaggtggtcaatgcttcggacccgcaggagatgacacaggtgctggcccagaccgtttttcagggcaaaagtgttgatctgacggacacgcaggagtacggcagcctgatagccgccagtctgggagaggagtggagcagcttcgggcagacgatgtttgtgcagccgctgacgcaggcgtgggaaaccgtgctgcaaccttcatcggccagtctcaacgaccagtggaaaaacgcggtggtggccaactggaaatcggcctttgatggccgctatccgtttgccgccagtaaaagtgatgcttcattgccgatgctggccgagtttatccgcaaggacagcgggcgcatcgacagcttcctgacccgtgaactgggcggcgtgctgcacaaagaaggaacgcgctgggtgccgaataaggtgaacagccaggggctgacctttaacccggccttcctggcggcgattaatcaactgagccaaatctccgacatcttgttcactgacggcagtcaggggctgcgctttgagctgctggcccgtccggtgccgaatgtggtggaaacgaatctggcgattgacggacagaaattgcattatttcaaccagatggagagctggcagagtttccgctggccgggggagacctacaaacccggcacgatgttgacctggactggtgtgagttcaggcgcccggttgtacggtgattatcaggggacatgggggctgatccgttggctggagcaggcaaaacagaaaaagctggatgaagggcgctatcaactgaccttcaccaccgcagataaacagccattgcaatggatattacgcaccgagctgggcaaaggcccgttaggcctgttgcaactgcgtaatttcactctgcctgcgcaagtttttctgatacagcacgcgccgcttgcgattgctgacatgtcagacgatgaagacatggcagaagactgatgtcttctatcatcccccccaataaacacccacaggagccgttatggcgacgttaactaccttgctcaccgcttgtgccgcagagcctgagccacttttacagcaggccagacaacaggttgcgctctgggaacgttggttgcaaccggtgacacccgataagcataccggtgaagaccccggttacgatgaccacttccaacagatgcgtgaagaggtcaataagctctcgggtgccgataccacgctgacctgcgagctggctgaaaagctgttcaccacacacggcaaggatgtgcgggtggcaacctattacgtctgggcgcggttgcaccgtgacggcgaggccgggctggcggatggcctttccctgctggccgggctgatcacgcgctttggtgagggcctgcatccgctgcgtgcaaccagccggaaaaccgcgttggagtggctggccggttcccggatgcgcgacagcttgtcactttacccggaagtggataaagccgattttgagcgtatcgtgggcgcactggcccttatcgaacaggggctcagtctctgggacgaaggtgtccggccgcaactgggcgggttgtataccgccctggaaaaccgcctcgtgcaatctggtgggctaaatgccgtggtgccgcaaaacagcagcgggtcatcatcggcaggcagcttgaacccagccaacacggcgtcaccggcgttgcggccagtgcaatcgggacgtgacctgctcgatcagaccaaaacgctggcaaaatacctgcgcaaccagccgcagggctggctctccgggcatcatcttatcaaaagcgtgcgctgggatacggtacatcagtcaccgccattagatgtgaacggacggacccggctggtaccgccgcgcccggaatatcgcgtacaactcaagcgcctttatctgcaacaaaactggctagcgttgctggaacaggccgaatcgatatttgccgaaggggttaaccatttctggctcgatgtgcagtggtacctgcatcaggccctcagcaaagcgggggccccattcgatggctgggcgagctgtatcacgcaggatttacggttattactgacccggctgccggggctggaagggctatgctggagtgacggcacgccatttgccgatgaggtgacgctggggtggataaaccagcaggtactggagtcggtctcgggctggggcagcgagcctgccgccgtttcatccggtgaggatggcattctgttgctggagccagaagctttggctcaggcggacagcgaagggattgaagccgcacttcactggttacagtcgcgaccgggtatcatcacggcgcgccatcagtggctgctgcgtctggtgatggcccgggtggcggagcaatacggtaagaacgatatggccctgcatctgctgagtgaccttgatagcagcggcgcgttgttgaccttgccacagtgggagccggggttggtgtttgaagttaaagcccgccgtttgaagctgttgcgtatgaaggcacagcggggtgacagtgataaaacccgcctgcatgctgaaatggaaagcctgctcagtgggcttatcgccctcgacccggcccgtgcggccgtattatgcggataacagagaaggaacagacaatggcaaaaggctattaccttggggttggggatgaaacaacctgcggcggcgtgatcatcgaaggtgacgccacacatgtcttgatgggtaaagcggtggcccgtgaacaagacagagtgacctgcggtaaacatccgggaacctatattattatcggccatgttcctggcgattcggtaaatggccgcaagtttgctggcaccttgaatagtcaaagcaattgcccgtgcaaggcgtggtttattccttctttggtgcatgatacgtatgagtttggtgcaagaagtaaatcacaaaatatgtctgaaattagtactgaagtcgaacgtgagatggtagaaaatgtgagtgaatcagaagaaaaatctaaagttgtctgtgcccatattgatggcgctttagtagtagcgagttatatccttgatgaaataaagaaaaatgtaaaaagtgataccgctgataaaatcagatcttttatcgataatgacctctataaaaaaagacttaaggagtggcaggattctccttggtacgcgagaatgaatgcacctccacagcctgaaataatatcggcatcggttttatggtttatggcggtcaagagtggtgctaaatgggatcataaacctaaaattagagatcaatttaaagcatatgcagtttctcgtcctctggtcggaagcggaaccctatcaaaaagctattttcataaatatgaagaacatgattatttttatgatgtctggtccaatattcactatggttatgtaggcttaagtcttggttttgatgagtcatatttattacttggctcaacccttgagcaagtaagaaccagcatcgggagtaaaccagatcctatagatgatattacatgtatgaaaattggctatgcactctatcatcaacatggaaaatatgctgagacgttagatgtcaggcatatactcgatgctcttgaatcagcatcggaccttgatctagctatttcaagacaaattcattggtgttggaataatgataattcgagtcaaattgatcacccgcagggtaagtaatgaaaagaataataatggttgttacgatttttatcgtattaggaattatttctatcactgttttttattttgttaagccttctatttttctttataataatactaataaaataatatatgtatattcttcggaaagtacctacggagttgaacccaatgaaaaagaagttgaagaaataataaaaatgaaaccagatgttatagaccctggtgaaacattgaaactggcaccatccatattatctttactgaaaaaaaatatcagaaaggatacaggttggcgtattgggggtagatactcattcaattcagttggagggggaggacaagcatttatgctcaccagagcctctggagtttgttcagtattgattactatcaatgataataaatctgaattagaagaaatagaaaaaagttattgttacaaaaaaataaagccatttaaagatagttatcctaatggataattaacctatcgtctttagtaataaataatgaaggtgagtgcaattgatttacacgcattaataaatatattgctctcactatttatctattcatctatttaccaaagctataaccaatgattatcttttttaaaggcattattagagtggattaattctccgaaattaagccattctttatctgattagtttctattttattcgtttcactgagaaccctatggacgacttaaccctgcgttattttgacgctgaaatgcgctacctgcgtgaagcgggcgaagagtttgcccgcgcgcaccctgatcgggctgccggattaaatctggataaagccggggcgcgtgacccctatgtcgaacgcctatttgaaggctttgcctttctgatgggccgactgcgggaaaaactggatgacgacctgccggaactgaccgaagggttggtcagcctgctgtggccgcactacctgcgtaccattccgtcgctttctattgtggagttcaccccacaatggcaggagatgaaagagcgcatgggggtgagtaaaggttttgaagtgctgtcccgccccattggtgaacgtgaaacccgctgccgctataccaccacgcaagatatggacctgctcccgctgaccctgcgccgtgccgggctggacagtgaacccgatggccggtcggttatccggctgcgctttgattgcagcgcgctggccgactggagccgtatcaacctgagccgcctgccgctctattttgatgccgatgcgccgctggcctgcgccctgcatgaggcgctgaccctgaataccgccaaactctggatccgtttgccggggcaggctgatcgccagccgctggacggctatttcgcgccgctggggttcggggagcaggatacactgtggccgaaggccgacagtgcgttcagtggttatcagctcttgctggagtactttaccttccgcgaaaagtttatgtttgtcgcgttgcaggggctggatgggatcgagctgccggcggaactgccgtggtttgagattgatgtggtgctggaaaaacgctggcaacatgatttttcgttctccgaaaagaacctgcgcctgcattgtgtgccggtgattaacctgttcccgctggaatcggacccactgtcgctctcttcattacagaccgaatacctgctgcgcccaatgcgcattcaggacggttataccgaagtgtattcggtggactcggtgatctcctcccgtcataccgggcatcaggtctatgtcccgttcaccagctttcgccacaagggggggatgttgcgccatgatgcgccggagtattactaccatacgcgggtcaaacgcgggccttcggggttacacgatacctggctggtgctggggggcgaggcgtttgataaccacagcgtaccggataatgaaaatttgtcgctgagcctgaccggcaccaacgggcagttaccgcgtaaagcgctgcaaagcacggtgctggatacggcggtgaaatccaccggggctcaggtgcgggtacgtaatctctccgcgccgtcattgccatgctacccgccgaaccgcgaccgttttcactggcgggtactgagccatctgggcagcagttttctgtggatgatggataacgccgaagtgctgcgcggcacgctggcgctgtatgactggacggacaacgaaatgaaccgccgtcggttggaggcgatcgccgaggtcaaacacagcgagattgaacgctttgagcggggctatttgctgcgcggggtgcacattgaaatcaccctcgacagcaacggctttaccggtaccggcgatatttgtctgtttggggaaatgctcagtcgcttctttgccctgtataccgatattcacctgtttaatcgtctgactctgatactgcaaccgacaggagaacgtttggaatgggaagagaatcatcagtcccgccttcccggctaatcacccggcttaagcgcgatatcggccagatcaatttttaccgtttctgtcagttgctggagcaacaaccgggaaccttgccgctgggcagtaccaacagcccggcggatgatccggtgcgttttcgtccgcatcccggcatgggttttccggtcagtgaactgaaggcgctggaaaacgacccgctgcatccggaagccccgttgaccgcgcgcaccacctttatggggttgtacggtgtggattcgcctttgccgacggcctatatcgacgatatcacccagcagcgcgaagggcatgaggcgctggaagggttcctcgatattttcaaccaccgttttatgacgcagttttatcgcatctggcgtaagtactcctatccggccacttttgagtcgggcggcacagacaatacctctcagagcctgttggggctgataggcatgggtattcctggctcacagcagcattttgccaccccaacatcgcgctttctggccttgctgggggtgatgcgacaaccggggcgcactgccgaaggggtacaggcgctggtccggctgctggccccgtttaccgaggcggatgtcacgccccattgcctgcgcacggtgcgcctgacttctccgatggcgtttgccgatgaaggggccaactggctggacggctacaccgtgctgggtgatgaggccattgatgccaacagtcagttgctgatttcgctgcgcacggcagaccgcgacgaggccgctaactggttaccggatggcccgctgtataccgattttctggtgctgttgcgggtctatctgggctggcgttaccgggcctgtatccaactgacggtcgccacccggttgctgccggcgttggtgttggatgagacaccgataaggctgggattaaccggcgtgctggggctggatgacgcgacgctgtcagacgatatacctgaatattttaccgtggcgctgggccactaccgtgggctggctccacagcaacatcaagaaggaaaccgacgtgttaactaccgtttggaaaaataaaacctgtacttcgaaaaataaaacctgtacttcgaaacataaaagctgggccgcctggaaaaataaaatctgcatccccgcactggttttgttgctcagtggctgcgggctgacgcaagccgtgaccgatagcaccgtgtcggccacaaaatcactgttttataagcagataaaggtgctgcatctggactttaccgcccgtgaagccctgaataccgatgcgcacgaggcgaactcgtcatcggagccggtaatggtgcgggtttatcagttacgtgatgataaaaccttcctcaaaacggtgtatcaacaactggcaagtgacggggaggcggcgcttaaagatgacctgctggccagccgtagtgtggtggtgaaaccgggcggggcggtaacactggatatgccgatggaaaaagagacccagtttgtggcagtggtggcgctgttccgccatccggatatggccaaagaccactggcgtctgatactcacgctggacgacctgcatcccgataagccccgtacccttgagttgggcaataacagcctgacattgcgggcggagaaaaaataatgccggattcctcctcgccgtcactgtatgagcaattgctgggcaatttcaccggcgggcttgacctgcatcaggtcagtgacgaaaaccaggtcattctctcggtgctggacaatatgcagcgcattcttaattgtcgggccggaacactcagtcatctgcccgattatggcctgccggacatgagtaaaattctgcaggggttgccgggcagcgcgcattcgctgctgaccacgctgtccgccaccttgctgaaatacgagccgcgtctgaaaagtttgcaggtgattctgttgccacagaccacacccggtcatctggaatacgccattgatgcggagctgaaagggctgggactggtgcggtatggcacggcgtttatgccggagggcagggtgttgatgcgccaccttaaacaacaacactacctcaatcagcgggagtcattttgatgcgggttccgggaagacaaccacatggcaggtaataccgagcgtctgctgaaaatcggtggcgacccgcgcgcactggcggatttcaccgcactgcggggtgaattaaataaactggcccacccggcccgcccggatgttgactgggcgcgggttgagcaactgtgtctggcgctgtttcgccagaacggcgttgagttgcagaccacggtagattttaccctggcgcgtactcacattgctggaatagtggggttatgtgaaggactggaactgttggcggggttggtctgccatcaatggagtgggttatggccaccgcaaatgcatgcccgggtggcgttactggcctggttgagcgaccggctgcagcaagagtggcgcaccatgacgctgtgctacggtgacctggcgcaggtgtaccgggcagagcgggcgctggaacagttgtgtacgcagttgcaaacgctggagctcaaacatttgtgcaagctggacggggttcgtttgatgctgcataacgcggcgcagcggttggaaagtaccgaggccgtgtctggccttgcgaaaccacggggtgcctctgaaccgcccgagtcgctgcgatttgcctctgtcccggtcagtgaaccactggtgtatattatcagcgaaccggccccgccacctgttcaggtggttttacctgcctcacctccgcgctggaaggcgggccacggttttgccgcggggttatcgttgatggcggtgctgatggccggcagtttcgttatctggcagtcggtatcatcggatcccgtgagggaaacattgctggccactgccagtcctttgccgacatcactgagcgctaactcaatagctgaactgaaaaaacaggcttcagatgttgagtgggcacgtctggcggaaccggtgttgcaagccagtgcgatgcagttagatcaactaacacagttaccgccgttatgggcgcaggctcggggggatgccttgctatctcaggcgcaacaactgtggccgaccaatcaagaggtcaaacgactgaatgcgttgtggcagcaacagcgagcagccggtgctgcgcccttggtagagttgaaacactatgcattggcgcaagaacggctgcggcaactggcagaacgactgaatagtctggatgagaaaaaacgcggttatatgacggtctccgaactgaaatctgccgtctttgctattcaacagccgctggcacaggccgtgccactggaagaactgctgcggcaatatcaggaacaattagaatcagggcaaactccatcctcagcactgcgtcaacagattgacagccggtttagtcaactgctgaaccgctatgcgttgctggtcgtacctcctggcgttcagtaaacactcggttgccagggaggattatggggcagacgcggtgattacagcgtgaagtagggttggctgtactggggcggcaggcgcaatatttgaatattattaattaatgatagcgctcacagcggggtgatcctgctggagcgcgacctttaaactgtattaacaccaatgaataatacggattagttaactacagtttgtgccatgttatttatttataatcaacctcatcccatccgttagagtaaatgacgtgagggacctttctgttattttcaattgcgtgtaaatcagaatatgatttgagttttttattttcttcaaccaaagagtaaaatgggtggcaggtatctaatactttgccattataaataactttttgatgattcctcctgtgattttcaattttttcagttttattttctgggatcatctctttgatggcattttttatttgatataacgcaaccagatctttgactaaattattacgatcctgtgccgtttttccttttttcaattctctctcttgtaccccactcaaagaatagtcctccggttcgtataaatcctctttcctttgactaatactctcatgcatgtcggttagttggttttcgacaaaataaaactcagctgttgttgaggcgttatagcgttcttgaataagggataatttttgtttaatgtcattaatagtatgttgggtctcagcatttataatgttttttttgattttcaatttacccaaggttttggatggtaaaacacgattacaatccaaatgttttacatagtcgtctacggtttttatacagctcaatgaaaggcccatattactctcctggtggttttaataaatgatgactgattgctaccgagatattattgattaaacacagaaagcaatctttcaaataaatcaagttgcttatattattcatattaatgatatttaagttttgtggaaatttatttataactaaatactattttgaatataagcgagtattaccaatgtgcagtatttattatatcgggctttttgagtggctatcgttatacccgtcatacttcaagctgcatgtgtgttggctgcttttgttacttgtcccatttatgggactcgcttctacgaggttgctgcaagttgcgttcaaatctgctctcggcgctgagtgtcaatgaccgttttcaccccagtcactgacttgttggtgaccttaaaataaataagcacctggggacttactccattgtcgttttcctgcaactcgaattatttgggatcttgggatatataggtaaaacgtcgtgtctgcgagctttgatggcacgatttttctgtcatgtctgcttgtcacacccgtcttcacctacttttctgccactctgctgagatttcgtgcaaaactggaggcgatactctcgccatcttgtggcataatgcgcgccgaatcacattttttattcttcttgaatatccctattcagtcatcaaatcgagagcgagctctgtgctaagtactaacaatatcaccatgcaattcggcagcaagccgctgtttgaaaacatttcagtcaaattcggtggcggtaaccgctatggcctgatcggcgctaatggttgtggtaaatccacattcatgaagattctggggggcgatctggtccctagcggcggtaacgtcttccttgacccgaatgagcgtctgggtaaacttcgtcaggatcaattcgcctttgaaaacaatacagtgctggataccgttattatgggacacggcgaactgtgggaagtaaaagaagagcgtgaccgcatttatgccatggctgaaatgagcgaagaagatggctataaagttgctgatctagaagttgcctacggtgaaatggatggctacagcgcagaagcccgtgctggtgagttgttgctaggcgtgggtattcccgttgaacagcattatggcttgatgagcgaaatcgcacccggttggaagttacgtgtattgctggcgcaagccctgttctccgatccagaaattctgttacttgatgagccaaccaacaacctggatatcgatactatccgttggttagagcaggtgctaaacgaacgtaacagcaccatgattattatttcccatgaccgtcacttccttaacatggtgtgtacgcatatggcggatctggattacggcgaactgcgcgtttatccaggtaactatgatgagtatatgaccgcagcgactcaagctcgcgagcgtttgttgtcagataatgcgaagaaaaaagcccaaatatctgaactgcaatctttcgttagccgctttagcgccaacgcctctaaatctaagcaggcaacttcacgtgctcgccagattgataaaattcagcttgatgaggtaaaagcctccagccgccagaacccgtttattcgcttcgatcaggatagaaaactgttccgtaatgcgctggaagttgagatgttgaccaaaggttttgataacggcccgttgtttaaaaatctgactctccgcctggaagtgggtgagaaagtggctatcctcgggccgaacggtattggtaagtctactttgctgaaaaccctgctaggggagtatgaatctgatgctgggaccgtaaaatggtctgaaaacagtaagattggttactacgcacaggatcacgccagtgattttgacatcgatctgacggtgtttgactggatgagccagtggaagcaagagaaagacgatgagcaggcggttcgcagtgtgctggggcgtttattgtttagccaggatgacatcaagaaaaaagttagcgtgctgtctggtggtgagaaagggcggatgttgtttggtaagttgatgatgcagcgccctaacattttagtcatggatgaaccaaccaaccacttggatatggagtccattgaatctctcaatatggcattggaaatgtacgaagggacattaatcttcgtctcccatgaccgcgagtttgtgagttcactggcaacccgcgtgattgaaatgacgccgaataagcttatcgactttaccggtaactacgaagattatctgagtagccaagggattcagtcataattatttgattgacctaacaaaaaaagctgatgctatgcgtcagctttttttatgtcttcacgttaagtaataataaataatataaaatacggacaataatagaaataaagttaaaatatagtgagtttactgtttaactaaaagtatatcgataaccattaatttaatattactgcatagcctgattctcaataaccaatagttaattatttaatggagcaagggatatgaatatcagtgggcatatagcaacgggtttagattatggttggcaggggatagggtatcttgaacgaggggttcattggttaaaaaccgggttagatgcggtagggaaatgtgctgggttacctgaattacagcctgcggtctatctctcatctctaaatataaaatacaataagattgatcaagacacccaagaaactcttaagaatattaacgataaattacaccgtgcctttttactaacatcgccggaacagatagaagaaaaacaaaaaattattgatgccgtgagtgatgacttagaaaaaatgaagcgtaatgtgctcagtgagagaggcgatttatattgtggtgaagaagtaaaactacatggaaaaatgcggacaacattaagtgaacacattacagttgaacgaagagataattttattaaatcactcgtcaacttatatcagattgtgagaggtgttaaggctacgattactaacgccccgaataatacaataagcagtttgataaatttaaattctaatgaatttcatagtggttttttcaagataggtgatgttttggatcgagattttaacgccattgaaaaaaacaatagagtacctaatgtaatcgttgatacgcattttgatgagtaaatataacaaagacaccatctgattttttttattcaactggggagtatttctgccccagtttaatgtattcattatagtggcgatcttctatcactctggcagacttcgcacaaaggatcttttgccagcgttatactgcgaaattccgcagtcatcgcgtcatacattaataaacgccctgataccagctgaccataatttgccaacagctttatggcttccattgcctgtaaattaccgataatacccactaagggagccattacgccggcctcgacacaggttagggcagtatcaccaaataaccggcttagacagcggtaacaaggttgattatcttgataagtgaagacgctgacttgcccctccatacggattgctgcaccagagaccagtggtttgcctagcgtatggcacagccgattgagttgctcgcgggtgctgagattatcggtacaatccaacactaactgatgttcagcaataaggctaaggagttgctcatcatctaactgtttatcaagggtattcagcgccagatgcgggttgatttctgataatgtctgcgccgccgaggccactttcgtcataccgatacggctatcgcgatgcagtatctgacgctgtagattggaaagggctacggtatcgaaatcgagcagggtgagatgcccgacacctgcggcagccagatattgcgccgctgcacagccgaggccacctaacccaacgataagtactttggccgctttcagtttctcttgaccgtcaaaatcaaaaccgcgtaatgtgatttgccggttatagcgcagggcctcaacatctgaaagttccggcaacatatcaacctccgacagggtgatgaatggcaaacggtcgattacctcctaacaattcattaaacaactctatttctacggattcccccacggctaccgaaccgcgttcccgttcaagcacgataaaacagttgccttgactgaatgaactgaaaatgtgggagccttggtggccagtcgtgcgaacctctaactgaccgtccgcattgctggaaaaaatcccacgttgaaagtccaagcggcctggtgtttttttcagtggtgttgtcgctttggcttttaatcgcagtggtggatgccattctgtatgcccggacagctttgccaacagcggttgtaccagttgatagaacgttagggccgcagagacaggattccctggcaaaccacagaaccaggcattgctgagtttaccaaaagcaaaaggttttccgggctttatggctaatttccaaaaaccaatatccccgagttcgtccagtatctgtttggtataatcggcttcaccaactgaaacgcccccactgctgatgaccaagtctgccgcagtatccgcctgctgaaatgctgcacgtagtgcatgttgatcgtcacggataacaccaagatcgatgatttgacaccccaattgctgcaacattagcctgacggcaaagcggttagtatcgtaaatctgtccttcagctaagggctgtccgataggctgtaattcatcaccggttgagaaaatagccacttttaatgcacgataaaccgcgatttcagcaatacctaacgaggctaatagcggtagctgtgctgcacctaatttaacgccagccggaaaaactgccgccccttgctggatatcttcacccgccagccgaatgttttgcccgattcgaatgttactattgaagatgacaccttgttcactcacgacagcgtgctcttgcatgacaacggcatctgcacccttggggagtggcgcacctgtcataatgcgaatgcaggtcttttccggccacacatctttaaacggcgcacctgcaaacgctactcctgcgacgggtaagggtatctcgtcgctcaattcatgccaacgtaccgcatagccgtccatcgctgagttggcgaaaggtgggacagcaataggtgaagtaatggcgctggcggtgatgcggcccgcagcctcagacaatgggatgacctctgttgctggcaatggtgtggcctgtgatagcattttggtcagtgcttgttccagagagagtaaatccgaggtattacagtgatccatgctgaactccgaggtctgggtgcgccgcggttaaaggagagtcacggggcagagctatcaattaaaataagaaggccattatggcagagattgcctgaggggtgaatgagcgcggccagtactgtggcaatttcacgtaaaaatgagatggcttgatactgcttttacgagcagtatcgttttcatcgtatatatatatcaagcgggttaatcgacatattgacagcttagccacgccactattattggtggttatttcccatccaagtcccgcacaaaatatattctttatacacagcaaatagtccatttatggcctaatctctcggggaaatatagggtttatcctaaaaatccgccttcaatataactttcattgtaacaatatttttaccaacacatagcaatataagtaaaagtccagtactggatagttatctgctctggattcagtttgcgtttacaccgtaggggcaaagaggttgagttataaggtgaatcatgaggcaacgttgacgccataatgatgtggcttcaacgaatatctgccagataagccttaatcgttgccagtaattttccggtaccacagcactcgtcattatatcctttggtatgcctgcggttgatcactcgatcatggggacaaccgccatgacagatagaaaaccactcacaatgttgcattttcctcgttgcagcgacttcttcgtctatcgcttgttgattgtgcgatgattgagttaacagcccggctaaatcagttttcagcaatgaaccataaatactgcctgcatcgcctctatatttgtcgcaaggagaaacatcaccgttaggttctaacgtaatgatctcttgtgagcaattgcctgaccaataacaagcagacagttttttttcaggattctccagtacactgataaaatcctcgaatatagcaatatgtattttttctcggtacccttttatccaaataacaaacagtgccgatagaaatttaatgaactcagcatagctgataaagttattaccaatatcttcacctgcagttagtcgattatcgggtacaatattaagaaattctatgccgtttaattctattaaaataaaataatctaacatttccctcatgtctgtttggtatacttcgcggtcaactacaataagtgcaccatataagatatcatatttttgaagtttttttattccttttgctatacgatccgatgtccctcttccacgaaaatccacccgacgcttgtcattaacagccggtatgccatcgaggctaatacctacgttcattcctattcccttaataaatattagccactcatcagagatattcactatatttgattgcatcgtgttagtgatatattgctctggccgtttaaattgctcttgtaaccaaattagcttcttaaagaaagcaggttttaatagcgtgacttcgccaccatgccagacaaactcgaaccggtttacatttgggatggcaagaatttggcgaactatgtgtataagcgtgctgaataaaatcgtttgattagggccttcggcccatgagtggcaataggtacaacgaaggttacataatcgggtggcttttaatacaatgactagctttcttgcttttattgctttagccaatatttttttagtccgttcgttatgatagatctctaattcatctgcatctaatattttgttggcaggtatttttccaattaaataagcagatagtaatttatatttacaggaactgaggtcctccagatcctgtatgcttaatttatttatttcgattgtatcaatgtatttaatgggtattgtttcgcgcatagtacactcctattttttcatgttaatattcccatctttcatgttgagtattctattactataacttgacgcttcatctgagtgtgtgaccatgatgatggtagtccctgactgatttattgcttttaattgctcaagtaccgctcgagcattcttactgtctaaattaccggtaggctcatcagccaatattaatgcgggacaagttaccatcgctctggcaatggccacacgttgttgttgaccacctgataattgcatgggtttatggttttttcggttatcgatccccaaaaggttcaaaatttgatttacttgctcaatacgctcttttttagcgaccccacgatatttcaacggcaactcgacattatcaaatattgataaatgtgggataagattaaatgattgaaatatataccctattaattcgcgccttaatgtgatccgttgagagtaacccaggttatcaacatgttttccggccaacgtaagcgatccggaatccaaggattcaaacatgccgacaatattgagtagtgttgatttacctgatcctgatggccccatgatagaaacaaactctcctttctctacagaaagcgttatattatttaggactctggtttttatgacttttgttgtgtaatatttttttgcattctgtaaatgtagcatattatttaaactctatgatatttgctgttttatcactatcatcaggcatttttacaatgcgttgacttggctgtaatccagatgtgatctctgttttaatcgaatttcgacgtttaacttcaacttttgttttaattgcacggtcatatttatcttgataaatatatataaaatggtcaccattgctatttgaaaacacactttcagttgggactaatagtacgtgattattttcttcttgtagtgcaatacgaatttcaatagattgccctcgtttaagatgagcgatgcctgattcaattggcctaagctttgctttgaattttccattgtctactattgctgatactgactctatcagtagttgagtatcttgaccatttatctgtgcgataatttgagtattaggttttatcttatcgatataatattcactgaaataaacattgaaataatatgaatttaaattgtctattactgatattttttcgcctgattttatttgttgacctaattcaatatcaagaacagataatgtaccatcaataggtgcaataataacgagttgctcaatgccaacttcaatcattttcatcattttttcaagtaatataatcgattcatctatgtttttaaattgagaagggaatgatttttggttcctactattatgcttttgtagtatattactcttagtcttccaatttattagtctatcggcctgtcgctctagttcagactttgcaatcaagagtttttcgtcaagtactttatatcttttcaaatctttagagattatatctatctggtgttgagcttcttgcaaactgagttgagtatctctgctatcttgttctaatctcattctcatattacggaggctatttatttgctccataatatccgccattctggatgtggcttctagtgtaaagtcataattagataatcgagcaatcacatcgccttttatcacattttcagcagattgcttgactatttcaataatcttaccccctctttcacttgataaaataacactctcattgggtaccgtaatggcgcgtgtcaccaatacgtcttgatatggctcaaattgagcagtatagaatatggctctttctcgaggaacgagcagggcgctttctttggtgaataaataataaataaaaaagcagcttaaaaatagaataagtaacacggaaagtataactattttctctctactgttgatatttatctttttttctaattttatatccatgttatttattctttttggtatgcgataaaatgagtgacaaggtcattacactgacgatactcaccataaacagcaaaagtgttccaaaggcatagaggtatgagagattattaatgaagttatatttactcagccatttttgtaataggataaaaccaatcggaaatgctattgctacagcaaccagtacgggggttatattttcctttataaagaaaatgatatgtgtatatagagagccacctactgactccattatttttaatattttactgatcctttttgattcagctattccgatgatcatggtacttatgagcagtaaggctactgagaatagggtaaccaagctgattgtttttttcattaaattgtgattattaaaatattcttggtgtatatgttcagcaagttttatttggttaatattgaccccatatcgttcaagtagcatttttacggtactaagatcactctgatgatgtaatttcagtgccccatatcgttgcacctcatcactgatgagaataagcaatggagttgtatttttatctcgatctgcaagataaaagtcattaactaccctgagtatacgaactgtatattcagcatcattgtcgttaatataaaaaagagtattcagtacctcatcacttgatgatttccccattgctgacataaaggtctttgtcactatagcatgataagtattatcatttttactgggtgtaatagggttttcgtagcctgctaatgtttttattccccaagtgtcggtgaaatttttgttcacgttcagtatatttacggaaacgagtttatcttgctcctgctgattttgatgaaaaaccgaagtcgtcgttcttgacatatcaaatggtcgccaactactcaatgcgattggggagatacctatgctattatttaattcatcttgtaagctatttaatgatgttaaagattttaattcatcgcttagtggaaatgtcacgacattttctttttcataaccaaacgtatgactctgcataaaatctatttgtgtcattatgcctgcccaaagataaataatgatccctgctatggctatttgtatagataacgttacttggtaaatgtaatgtgatattgggtgtgcactataagcatgattatgccatgacttattagggaaaactgaggttgatagatagaggtaatgcgaaattaatatcgcaatatagagtgagaagaacgctacagaaaatgatgatattagccggcctgtttcttgcgttaaaatcaattccctgacattttcagatgcttgcatcaaaattgagaggaagataaacgccagtgtgaggacacacaccgcttgcagtgttgcgatgaaaaatgactctgtcagtaattgataattagaggcaccaaccgatttctttatctgaaaactgctttttttgtttttatttacgatgttattaacattgaaaaagttcatggtggtggttaaaaagataaagaaacccgccatatacaaggtataaagatatgattttgaaataactgtgctcatttcatcggggagttcagcatcataatgtatatcggtaatattacgggcggataattgaataaactcttcagggctaaacggagcgccagggagttgaggtgcataccgggtgaccagcgtttttaactgctcatgagtgggttttcccccgccgaccatggtgacaaagagatagctgtgcatatcgtaccagtcatgccttttatcatggtagtcatcgatgatatccggagaaaatgcaatgacagcgcgggtgttaaagcggctggacgtatttaagttaaccacatctttgataaagaatttccctttttttcctaacgtgatgacctggcctttagggtgatttaaatgaagatattggcgattaaactcaggcgtaatgataatttcattgtgtgacagatgaggtattttctgtcgatagggattgagtgccgttaaaaaattagggctaacagcataaatttctacgtcagcctgtgttttaccgttaacctgtaagtcgataaacaagcgtaaagcgtaggcgacatctttgatgtttttttcattttgtaatgcagtaattaatggcaaagggacttgtgccgatttgactttttcaccattgggcagattaaattgtgtttctattcgataaatttgtggataatcatgatggaatttttcaatactattatcagttaaataaagcagtaatacgagaaacagtgagatcatccctatagcggttataataatggctaatagtgttgccatggggctgagctttacatcgtttaaaaattcactcgtaagcatacaagaatatctcactgggattattatatttagtgatattattatttttgttttatttataacgtctaaaatgcttgatgaacttagtcttctgcaaagctcctcgaccaactccatgccgttatcttactgtgtagggtattatttttaatttcgtctatttcattgctagtgatatatagtggattattcttgaatgattcctctaacgatttcagcttactctttaatttaattaagttaacattgctcttttctaccgttgattgggatgaagggttcatgttattctccaattgatttgtattggggctgagagtgattgcaactctatttatttgtaattcttttcttcaaatttatcaatatttttttattcttaatggttacttgttttttattatctccaattaattatctgattatttattttattgtttattattttatggtcttaaacgaggttttaatgtgaggggttttatctatcgaataaaaagccctcgaaagggcttggggttttatgtgtaataattaggctaatgacaaatgttacggctgtaggtgtgcagcatgaaagcgcaggtgatcttcaataaatgtagctatggtaaaatagctgtgatcataacccggctgaatacgcaacatcagtggccagtctcgctggcgcgccagctccgccaattttgccggttggagttgatcggcaagaaattgatcaccatccccctgatccaccaatataggcaactgatgctgtgcatgggtcagtaaatggcagctatcatattgcagccattggttttcatcactgccaagataagcggtaaaggcttttcggccccatggtacttggcatgggttaactattggcgcaaaagcagaaacagactgatattgttgcggattacgcagagccagcatcagtgcaccatggccgcccattgaatgaccactgattgattgccgttcactgacgctaaaatgttggcggatcagtgagggcaattcctggctgatatagtcatacatctggaaatgatcagaccacggctcctgcgtcgcattaaggtagaagcccgctccctgacctaaatcatagctgtcatcgttgggaacattatcaccgcgggggctggtatcaggcataaccagtaccagcccgagttctgcagcaacccgctgtgcgcccgctttcagcgtaaagttctcatcattacaggttaggcccgatagccaataaaggactggtggtgggttatcgtcccgtggcggtggcagatagatactgaaggtcatatgacaattcaggctgctggcagcatggcggtagcgctgttgccagccgccaaacatccgatgctcttcgagaagttcaagtgacgtattcacgttttgtctgcctccttgctttatttgctttcggaagagtgattaaaatggatcacactgcggatagatttaccctcgtgcattaaatcaaaggcttcgttgatttgatccagcgccattgtgtgggtaatgaagtcgttcaacgcgaatttaccgtccaaatattgctgcacaatgcccggcaattctgagcggcctttgacgccaccaaatgcagaaccccgccatacgcggcccgtaaccaattggaacgggcgggttgaaatttcttcaccggcaccggcgacaccaataatcaccgactctccccaacctttatggcagcactctaatgctgaacgcatgacattgacgttaccaatgcattcaaatgagaaatctacaccgccgtcggtcagttcaacgatcacttcctggataggtttatcatagtctttcggattgatcaggtctgtcgcgcccaatttgcgggccagctcgaatttgctggtattgagatcgatcccaataattcggctcgcccccgccatctgtgcaccaatcaccgccgataaaccgataccgccaaggccgaagattgcgacggtatcacctggtttaacttttgcggtattcatcaccgcacccatcccagtggtgacgccgcagcccagcaggcatacttcttccaacggggcttctttattgattttcgcgagtgatatttccggtacaacggtcagttcggagaaggttgacgtccccatgtagtggaagatgggttgaccatttttagagaagcgggtggtaccatcgggcatcaaacctttaccctgagtgctgcggattgcctggcacaggttggttttaccggagcggcagtacttgcactcgccacactcaggtgtgtacagcggaataacgtggtcccctacggcaacactggtgacaccttcgccaatggcttcaacaattccaccgccttcatgacctaaaatggtcgggaatacgccttcaggatcggcccccgaaagggtataagcgtcagtgtgacaaacgccactggcgacaatccgcactaacacttcgcctttctgtggtggcatcaaatcaacttcttcaacggacagtggctggtttggcccccatgcgacagcggcgcgggttttaatcatctccatggtgttgctcctatagcttcagtgtaatgagtgttatataaatctacccgtcgcccttcaaggtgctggggggttaactgtccttgctcaccccagtcactgagttatctaagctcctaggggttgctcggttgctgcctccctgcatcatgaggtaacttgggtatagagtctttatgtatcaaatttgttgataacagttgttcgggatcatagcggaaatatatgtatagattatggccgaacagataccgcccaccagatcaattcaatcaaggtatttcaacgttctcgataatcagctcttttaatgcgcggacattagggctgaaggcatctttacgccaaataagccaggttgccgtgtgggcaatatccggaggtaacggatgaacttgcacccgctcatggcccggtagcagcgtaaggactgagagagggatgagggccagcccggcgccactggcgacacaggccagcatcgcatgataggactggatttccatgatatgccccggtaatacgcccacttgtcgaaaccagctttccaatcgcagccggtaagagcaactggggcgaaaagcaaacagcgtttcgtccacggcatcgcgggcttgcagtatgggggggcgttcaagacaagaaatgatcaccagttgttcgtcgaaagagcggcagccgtgtaactcatcgtgctgcaccggaccatcgaccaatgcggttgccagtgtacccgcgcggacttgttcaataatttcacccgaggttccggtaatcagcgacaacgataccttggggtagcgctggtggtaggctgctagcaaattaggtaaacgggtggcggcggtgctttccattgaacctaacgggaagttacccgccggttcgcctgcgtgggtaatgctcatggcttcttcgcttaaggccaaaatacggttggcataacagagaaaattatggcccattggtgataaacgcaggcgctgtttttcacgaataaacaaatcagcccctagctccagttcaagctggcgcagacgcgtagtgagatttgaaggaacgcggtgcatttgctccgctgctcgggcaacggagccggtttccgctacacaacaaaacatgcgtagctgggtcagatccatagatgttctctttttgtgatgaacttaatgactattattcattttttgtgattctaatactcaggcatgatgttagcaactttcttttaactgacgggtgaaataccccatcacccgtaacagataggcaggcagatggcgctaagagttgcattaagtggttttttggcattggtggtagcaatgggtattggccgttttgcttttacgccacaagtgccgctgatgattgcagagcatcaattcacgttgactagtgcgggtttggtggcggcattcaattatttgggctacctgttcggtgcctttgatgccatgagagccagccgtcatgttgagcgtcggttatggttggggctatggggtgccgcattgcttacattattatcggcggtggtggttgggccatggtggcacgggttggtacgttttgctatcggctgggccagtggctggtcgatggtattaatcgctgcctggaccaacgaacgtttggcacattttggccgtccggcgctcagtgcggccgtatttgccgggccgggtgccggtatattcattagtggcatgttagccgtcgctatccatagctatgatttatcggctgctgaggcttggtgggtttatggtgtattggcgctggttatcattgcttcaatcagtattaatctgccacgtggcggtgagttgcaccggccacaggtcgtagcggtgcctttgacattaactccggccttgaagcgactggtctggagctacagtttggcgggctttggttatattttgcccgcaacttttttatcgcagatggccagcgcccgttttcctgatagcctatttgcgcagtttgtttggccagtcttcggtggggcggcggtcatcggcattgcattgggtattctgactcgccattgcctgacatcgcaaactcgattggcattgacgctatgggttcaggcgttgggcgtgctgtgcgcagaatgggtaccaggagtgagtggattggcgctgggagcattgctgaccggaggtgggtttcttagcgtggtacaactttcgttgcaacatggacgcgagttggccccagagcatacccgttatatggccggcttactcaccactggctacgcgatagggcaattagtcggtccaatattgtccgcaatttcaacgacattaactcatcgtttggagccagcgctgtatgtggccgtggtggcactgattattgccggcggtctggtcattaaaactccagcgcgcacccaggaagcgcttgccacgtgatgacgatagagagaggcgaatatttcattacgatgatcagtattgttcgcaatgaataaccggtcgaaatgaagaacaatcactggataatcatttcgctctcaattagagtgagagcgaaattcgggtgtgacccgcatcatgcttgtcttatctggatgcgtaagcctgttggagaaaagaatgtcatcgctaagtaaagaagctgagttggttcatcaagcgctgctggcccgtggtcttgaaacccctttacgtaaaccagaattagatgccgagacgcgcaaaactcggattcaggcccatatgacagaagtcatgcatttgctgaatcttgatttaaccgacgatagtctggctgatacaccaagacgcattgcgaagatgtatgttgatgagattttctccggattggattacgaaaatttccctaaaatcacactgattcaaaataaaatgaaagttgatgaaatggtaacggtacgggatatcactctgaccagcacctgcgaacatcattttgtgacgattgatgggaaagccaccgtcgcttatattccgaaagacagtgtcattggtttgtcgaaaatcaaccgtatcgtgcagttttttgcgcagcgtccgcaagtgcaggaacgattaacacagcagatcttgctcgcattacaaaccctgttgggtaccaataatgtcgcagtttctattgatgcagttcattattgcgttaaagcacgtggtatccgtgatgcgaccagcgcgacgaccaccacatcattaggtgggttatttaaatccagtcagaatacgcgtcaggaatttctgcgtgcggttcgtcaccacggctgattggctttttgccagagggagggcctgtaggccctcgaatacaggatgtcgagtatgcgtcaacgcatcgcaacgttagacagtgcgcgggggctggccattcttggcattctgctgcttaatattagcgcgtttggtttgccaaaggccgcttatctcaatccagcttatcttggtcttccctcattatcagatatctggacttgggcgatcctcgatattgtcgcacaggtaaagttcctttctatatttgccatgttatttggtgcaggccttgagctgttacttaagcgtgggaaaagttgggtacgtgcccgcctttctttattgttactactggggttaattcacggcatcttcttctgggatggcgatattctgttggcttatagtttgattggtctggtgtgttggcgaataatccaagatgccaaagatgcagccagcttattacgtaccggcgcggtactctatttgatcggtgtcgctgtgttgttgttgctgggctatattacccgcggagagccgggccgtttttggctccctgggcctgcggatctgcaatatgagcaattttggaagttacagggtgggggagaggcttggcgtaatcgtctgggcctgttgtcatccaacttgattgccattggtgcgcaatatggttgggagttggcaggctccatggtattcggcgctgggttgatgcgctgcggctggctgcggggagaattcagtctgcgtcactaccgtaggctcgcactctttctgatatcgctctcattggttatccaaataccgggtgtggcactgcaagtgtatgtcggttgggattaccgctgggcgggttttttgctacaagtgcctcgagaattgggggcgccgttgcaggcggtggggtatctggcgctgctctacgggttctggccaacattatcccgctgggctatcagccattggctggcaaaggttggccgtatggcgctgagtaattatttattacagacattgatttgtacgctgattttttatcattttggtttataccaacagctcgatcgtttgcaactgttagccgtcgtaccactggtttgggtctgtaatgtgattttttctctgttatggttacgctatttcgtgcaaggccctgtggagtggctatggcgtcggttaaccgcttatgcctgcggccaagagttacaaatacgcaacactaagctctgacagaatcaaaagagaaaaatgatgttgtgagttgcaaatatgtatgtaaacgttttctttttgtaacatgtgtcacgcggcaatatccataaattggagagaatagggcgcgcagccatattgggtcgcacctgatacgtacctggttgtttcttgcaagataatactgtatccactttgcgttcactggtgggctttgatgatatttctattgctcgctatagccgccttaatctcaatttagtctgttatcattttgtttttacaacaactattcccgccatacgggttcttaaagctacccatcatccaaccgcccctccataaacatacagctttaaacccgccttggtaccgagtcgttcactcacaatttgtggtgttgctcactcgttatctatttattcttgtgtaaccggtttcaatctgtgagaaaattcacagtttcttaacaacgccacgtctatgctctagtggttttatacctgaatgcgtcaatatgtcatcagttaccggataaaaaaataagcggtagcgggttttagaagagcactttgcagatgcgtgttccgcataacatggcaagtctgtaaatgacatggcttttgaataatcaggcggttttttcggagtggagtgaagtcatggacgatagatattcagttgccagtagctttagacgatgcttttttcgttaaggcacggtgttatcaccttgtactaccctacataaacccggagatacaaatgaataagaaggttttcacattagcagctttggttaccagcatgatggttggcgcatacgctcaagctgaaacccgtattggcgttactatttataaatatgatgacaactttatgtcagtggtccgcaaagctatcgaaaaagacgcgaaagcttcccctgagatcactctgctgatgaatgattcccagaatgaccaatccaagcaaaatgatcagattgacgtattgctggctaagggcgtgaaagctttggcaattaacctggttgatcccgctgcggccccagttgtaattgataaagcacgttcaaatgatattccgattgtattttataacaaagaaccttctcgcaaggcattggatagctacgataaagcttattacgtcgggactgactcgaaagaatctggggttattcagggggagctgatcgctaaacattggcaagctaatccagagtgggatctgaacaaagatggtaaaattcagtttgtgttgctgaaaggtgaaccgggtcatccagatgcagaggcgcgtactacctatgttattaagaccctgaatgaaaaaggcttgccaacccaacaattgcagttagacaccgccatgtgggataccgcacaggctaaagataagatggatgcatggctgtctggtcctaatgcaaacaaaattgaagtagttattgccaacaatgatgcgatggcaatgggtgcagtagaagcactgaaagcacacaataaaaccagcgttccagtctttggtgtcgatgccttaccagaagcgttagcgctggttaaatcaggccaaatggcgggtacagtgctgaatgatgccaataatcaggcgaaagcgacctttgacttggctaaaaatctggcggctggcaaacctgcagcagaagggacaacgtggaaaattgaaaacaaaatcgtacgtattccatacgtaggtgttgataaagataatctggctgaattcactaaataatcactgtgacaagatatatttattaggcaaaaatatagacccaaaattattggcgtgcaggagggcaactggtcctcctgtagcgtcaaatactatggctatataccgggcgttcaatgccggggctgaaggttatctgttacatagtttcttattttaaagattgcgctggtctggtggtactccatatcaccaataggcaagtagcagttcttagccaggtgtaattatggccgatattaatacagcacaacctcgtgactggttactggaaatgagcaatattgataaatcatttccaggcgtgaaggcgttagataacgttaatcttaaagtccggccctattctatccatgcactgatgggcgaaaatggtgcaggtaagtcaacgctattaaaatgtctgtttggtatctataaaaaagattccggaagtattattttccagggacaagaaattgaatttaaaagttctaaagaagcattagaacagggtgtttcgatggtacatcaagaattaaacttggtgttgcaacgtacagtaatggacaacatgtggttggggcgctatccaaccaaaggtttttttgtcgatcaagacaagatgtataaagagacaaaggccatctttgatgaattagatattgatattgatccgcgcgataaagtagccacgttatcggtatctcagatgcaaatgatcgagatcgccaaggctttttcttacaatgcaaaaatcgtcattatggatgagccaacctcttcactaacagaaaaagaggtgaaccatttattcaccataatccgaaagttaaaggcgcgaggctgcggcatcgtttatatttctcacaagatggaagagatattccaactgtgcgatgaaattactattctgcgggatggtcagtggattaccacccagcctttggatggtttgacgatggatcagatcatttcaatgatggtcggtcgctctctgagccaacgttttcctgatcgcctgaacaagcccggtgaagtcattcttgaggtgaagaatctgacctcattgcgccagccctctatccgcgatgtttcctttgatttacataaaggggaaatcctggggattgcaggcttggtcggggctaaacgcacagatatcgttgaaactttatttggtatccgagaaaaagtgaccggcacgattaaattgcatggtaagaatattaataaccacagcgctaacgaagccattaaccacggttttgccttagtgactgaagagcgccgttcaaccgggatctacgcttatctcgatatcagttttaactccctgatctctaatattcgtaactacaaaaataaatttgggctgctggataacactcgcatgaaaagtgatacccagtgggttatcgatgcgatgcgggtaaaaacgccaggccatcggacaaatattggttctttgtcgggggggaatcagcagaaggttattattggccgctggttactcacgcagccagaaatattaatgttggatgagccaactcgaggtatcgatgttggcgctaagtttgaaatctatcagttaatgactgaactggcgaagaaagacaaagggattattattatctcctctgaaatgcctgagttattagggattactgacagaatactggtaatgagtaacggtcaggttgcgggcattgttgataccaagcaaaccacgcaaaatgaaatattacgccttgcatccttgcatctctaatctagttgaaggttcttattatgaatgtgttaaataagaaagatatgctcacttactttaaagagagcgggatttatgtggtgttgtttgtgctattggcaattattattatcaaggatccgacttttttaagtttgatgaatttaagtaacattctgactcaatcttcggtgcgtattattatcgcgttaggggtcgcgggtttgattgttacccaaggcacggatttgtccgcaggtcgtcaggtagggttagccgcagtggtcgctgcgacaatgctacaatcgatggataacgtgaataaagttttcccggacttgcagactgtacctattccagtggtcattctcgttgtctgcctgattggggcggttattggtttgattaacggtataattattgcgtacctgaatgtgactccatttattaccacattaggcactatgattatcgtttatggcgttaactcgctgtattacgattttgtcggtgcttcaccgattgccggttttgatcctgctttttcgacttttgctcaaggtttcttgcggtttggtgattttaaactgtcctatattaccttttacgccttaatagcaattatgtttgtatgggtactgtggaataagacccgttttggcaagaatatttttgctattggcggcaacccggaggcggcgaaagtctctggtgtgaatgtgccactgaatttgatcatgatttatgcattgtcgggggtgttctatgcctttggcggtatgctggaagcagggcgtatcggcagtgcgacgaacaatctcggatttatgtatgagctagatgcgatagcagcctgcgtggtgggtggggtgtccttcagtggtggcgtcggtaccgtgatcggcgtggtgaccggggttatcatcttcactgtcattaactatgggctcacgtatattggtgtgaacccgtactggcaatacattatcaagggcgggattatcatctttgcggttgcgttggattcactgaagtatgcgaagaagaaatagtcggttgttgttcgtgaaagcacgatcagctctggcgtactgttagttcagacgtacatatatcactatttcaggcatatcactatttcgtgtatatcactatttcagacatacaaccatttcaaatagacagttacgtcaggaataaagtaaaagccagtcagggcgatagccctactggctgaagttaatgacaaagtgcctgcggcggagagaaataggcaggcccgcttccctacataaaaatagcttccctgggggctcgagccgcacgaaccgtggcgcggatgctttattcctctgcctattctcaccgttttagatcgagtcatcgggttttgtcggcggtctgagtcagtcagggtgaaagcccaactgactgaagttattgacaggtggttctcgagaccggttatcggtagttttatcgccctgcgaggcacttcattggcttggttgtttcttttctgccaaccggcgctccagttcgactaactgatcgggtgttaccgctgggtaaccttgtgcgtcatctggtatcacatgcacggccggaatggggatcaatggaccaagaaagcgaggttcccgcttaagaatatagaggtcagacagggcaccaaggcgcgcaaaaatctcccgtactcgcacgctgagcatattttttggtgaaggtactgcgaagcattgtgcttgaatgcccatgtacatggcgataaataatgcccgctcacagtgaaagcgttgggtgataataatgaaatcattagtatcaaagactttgcgagtgcgcacaatggagtccagagtccgaaaacctgcataatccagcacgatatccgcgggagcaacacctgcagcgattaggtcgcggcgcatggtcattggttcgttatagctgtgctgggcattatcaccactgagcaataaatagctgatcttaccgctgttataggcatttattgccccttgaatgcggtattgataaaactgattaatgccaccggtacgaaaatatttcgctgtacctaatactacaccgacctgccggtgaggcagttcttggagttcatcgtagataaaaggcgcagttttccaactgatccagcgatcgagcgcaatagctgtcaccatcaataatccaatgatgataattaagctaataatcaggcgtttccacattctctggcctttgatttgtgcaacttgctggcgatattggcaaggctactttacctgcctatgctgtgcaagacgtgcagacagtttctttccttggcatgagagttatttataaaaacactttattgataaaggtgattcattaataaacgcatgtgctttggggttacaagtaactttttgttcaacgctgtttttgttaaaagtgaccacggtagaaaaacggtggtggatagcatctgagtacccggcctgcggtatagcacaggccggattatattcaaaacgaggtgcgtttatagctacggtactgtggttgccaataattgtgctcaatggctttagacaacgcttcttccgaagtcacaatagcaacaccttgtaattgagcggcttgaccgacccgcattgcgatagctttcgataccgcctgaatatcatcgatattaggcagtaaggccccttcgccatgacgtgcgagtggtgaactctctgctaatgcccggctggcagccattaacatgccatccgtgacacggctcgcaccagatgccaatacacccaagccgataccggggaagatgtaagagttattacattgagcaataggatacagtttttctttataactgactggtgggaatgggctacctgtggcaaccagtgccgcgccatcggtccagttgataatatcttctggtcgggcttcaacccgtgatgttgggttagacaatggcatgacgataggccgggcgcaatggctgtgcatttcacggatcaactcttcagtaaacagccctggttgacctgaaaccccaatgagtacggttggtttggcattacggacaacatcaagtaatgaaatcgcatcattgtgcagattccagtggtgtaggtcgtcacttttttgtaccaatttactttggaaatcgagcaagttaggcagtttatctgtcagcagaccaaaccggtcgaccataaagatccgcgctcgagcttgtatttcgcttaagccctctgacatcatttgagcgatgatctgctcggcaataccacaacccgcggaaccagcaccaaggaaggtgactgtttggtcgcgcagttggctacccgcagcatggctggcggcaatcaggctacccagagtgactgccgcggtcccttgtatatcatcattgaaacagcataattcatcgcgatagcggtttagcagcggggtggcatttttctgtgcaaaatcttcaaactgcaacaagacatttggccaacgacgttttaccgcctgaataaattcatcaacaaatgcatagtactcgtcaccggagattcgtggatgacgccagcccatatacagtgggtcattcaaccgttgtgggttatttgtcccgacatcaagtactacgggcaacgtgtaggctgggctaatgccgccgcatgcggtatacaacgataatttacctattgggatacccataccgccgataccttggtcgccaaggcccagaatacgctcgccatcagtgacgacgataaccttaacattttgtttggtggcattttgtagcatgtcatcaatgtgttcgcggttcggataggaaataaataacccgcgtgcacggcgataaatatcagaaaagtgctcacacgcttccccaacggttggggtgtagataattggcatcatctcacttaggtgagcttctagcagacgataaaacagcgtttcattggtatcctgaatattgcgcagataaatatgcttatcgtcgtcgtttttaaaatcctgatactggcggtaagcccgctctgcttgctcttcaatggtttcaaccgcttctggcaataggccatgtagattgaaatgattacgctcatcattggtaaaagcactgcctttattgagaagtgggaactccagcaatattggaccagcgtaggggatgtacagggggcgcttactttcgtattcaagttccatgagttcttactcttaaacgttatcaaatagcaattgttaccccgatcctaaaagataagaaaaatatgtacagcatttgttagcaaattatgacaattgcccgtaaaagtgcgagttaacttacagatttaattgctggaagctaaagcgctgcataatgtacgcgggcagctacgcattttgtaattaaacaccttcgattattttctgtttatgttattacattggcaccgattgattgacggctaacccaaatcgctgtgaaagagatttccagtgttttcatatcgccatgcttgattgtggggaggggggctagtcgcctaaccccgaccatcaataagttgttatggtattaaaacgtcacgcgttttaccgctgaacagcccaaggcgttcaatgtcgccaaggttgtatcccactggctcgtgactgcgttatggccttcaaccagtacagcgcggcggatcgacgcacaattctcaccggtgatattggccaagattagcgcggcttgcagggggggcaggctagggttaaaggcggcattttcagcataacggccagcataaatttttccattggtggtttctagtgccacaccactgtgggattggctgtatggcgcatggctatgatttgcagcatttaacgctgcctgcgtaaggggatcggtttctgctagcgtgtaaccgtgattcacggggtccatcaaaagtgttgtgatcgctaaatctgttggtccaaaagagtctggtaaatattggcccagtgttgatggcgggcggccaggtagatgaatatgtaattcagacccacagttcaattcattcataaattggcggcaatggccacatggcgtgtaattgacagtgatcgcaaccagattggtttcaccacgcagccaggcatgggttaccgcgcattgctcggcgtggatcgtctgttgcagtggtacaccacggaactccatattggcaccgaaataaaaattaccactttttccacgggcaatggcacccacattaaaatgggatataggcgtaagcgcacaagcggttgctagcggtaacaaggcaaaagccaaggcatcatcatccaggccactgatattttttactgttttcacttgctcagcggtcagcatagcagggaagttttctgcgctcagaataggttctagtgcgaattgtaatgaggcgggtaactcagcccaagaggtgtgaaaacgtgcttgcataaggttctctccagtagtcgcaggagactagtctaggcagattggaaacctgtaattgtgatttatatctcgttatttatgaaattcatgtaattaaaattcaaaatgggagacttatctcaagtttataggcaagtaatggtgacagcccacatcatgatcgcaggcactggatatggttttagactctggctatggttttagatcctagctaaggctttaaatcctaactacagcttagaccttaacgataattggcggctctgataaggtctgataaggattacagaccctgacgtcgctatcacgccaggggaaagtgggttcaaccaaacaaatgtaataggaccgggaacaggaacggagccagtagtgaggtgataatcccgcaaatgactagggctaaagagctgaacgcaccctctttaaaatctagttcggcgcaacgggcggtccctaaggcatgagacgccgtccccatcgccaatccacgggatgctttggtggtgatttttaataaattcagcaaactgtggccaaacaccgcccctaaaataccggcaaaaataacgcaaactgcgctaatagcgggtaaaccatgaagagactctgccactgccatcgcaatcggtgtcgttacggatttaggtaatatggacgccgcaatttctggcgttgcccccatccacagggctatcgctgtaccgctgaccatggcagtgatactgccaataaagcaaatggcaataattgatttccaactggcgcggatctgatgtagctgctcatacagtggaaaagcgagcgccacgaccgcgggttgtagcaagtcattcagaattttactaccagcaaaatagttggcgtaaggcatatgcgtgactaatagcaatggaataataacgaccattgatatcaatagtggatttagtagggggattttcgcccaacgggatagctggcgtgcaccaaagaacaccattaaggttaacggcagtgaccaccatagattgctgatcatttttccccctcagtcggtgttgaagggctaatgactttgcggtcacggtggacataatgtgagctataggccaccactaacataacaattaaggtactgataaagcaggaaaccacgatcggaccgaactgtttagtgagctgttcgtaatattgcatgactccgacgcctatcggcacaaacagtagcgccatatagcggatcagtaactggcagcttggttttacccaaggtgagggtaaaatctgcaaggtgagtaagacgaacagaatcaacatgccgatgatactgccggggatgacaatcggcagaagtaaggccagagctttccctgcccataagcacaggtaaataatggtgaaagctcgcaggtactgccagcaaagtgacatcatattacgcatagatattgtcctgggtgacttaacacaatcatcatacaattaacttttgttctgtgctacccatcacactatgaatagcattaatgatgcaatgacactcacggtagattctccgggtgataaatcagtcaagcgtcgggggccacctaacgtattctgacgacgggagtttttgggtgagcgcgcatacaaattattttttctcatcgggatagcgtactttcaatgccttatttggtcgctattttgccaaatggtagccgcgatagaagagcaccagacctaaagtagccgcaataattagcatataaaacatcatttcgggcaccgtgtaggctagcagaaaaccacagagtaccgggttaattgctccgccgagttgaccaaggttctgcaccccatagtaactgcctttgaggtttgctggagcaataaagtcgataaacaggtattcggctggaataacaataatttcgcccaatgagaaaatggccattgccagcatccataacggaatggaatcctgagctaccataaatcctagcaaaccaataataaagaacagggtgcctatcatgagccaacgcatcaaattttgttggttcatacggcggcttaatagatattgcagagcaatgacgatggtcgcattaacggtcattaccgccccaatcacctgataagcaaatttggcgtcgaataccgtgatcagatattgggagaggtaaccggagaactgagcgaataccatggcgccgagcaggctaccgagcgtaaagtaaatcagccgcttatcgtgacgcaatatattgaatgtttggcgaaggtcaggtactgattcgctagacacccgttcagtcgctaacatatcggcgtcatttatcctgaatttcagcacgatagcaaccaataaagccaatgcacctgaaatgataaaaggcagttgtgggccgaaacccaccactaatacccccattaccgggccgatagcccaacccacattgaccagcgtgtagttggctgaaaacgctttaatacgttcattgaccggtagccagtcggcaaagcacgcttttaccgcgatagtgtagacggagtaggccgaatgcagtagcgccagagttaaaatgacccaagcgggatgttcaatccacggtaatgcaaaaaaagtggctgagaataggattatcgtcagtaaaatcaatcgttttttattaaatttatcgaccagataaccgccatacagactggtaaaaatacccaaggctaaactggcacccaatagcaggccaacggtatctggggccagttgaaaatgctcgaccaaataaatagtaatgaacggtaaggtaactgcacgccctatggtcaacaccaacgaagcaatcagcagattggttacgcgcgatgagaatctttgcatgtattttcttatttttagtgatttatagaataatcaattgtttttttgcgaaatttaagcaaaaaatgggcctgctagacttctggcgactcagctgaatacagtaaactattgtgataataaagagaggggggcgaaaggaaaatttttgcaggaagcagttcggccagagccgatctgctattattttctagttatccaagtattttctagttatccaagtattttctagttatccaagtattttctagttatccaagtattttctggttagctcaaggagtttacgatcaacctaagtggttaataaacatccaaactacttgatggttaacttgggtgattgatagttaacctaaatattcgatgatagagaggccgccgttataatcggtactgtagatgatgccttgagtgtcaacaaatacatcacatgattgaataatttgtgggcgaccagggcgcttatccatcattttttcgggggctgctggaactaacgcgccagtttcttttggatgataggggttactgatatcgtaagctcggaccccagcattttggtaagtagcaaaaattagagatgaactgataaaactacctgggcggttttcatgcagattgtgtgggccaaaatgagcgcctttttttatataatctcgttcttccggaaccggaaacgttgaaatactcaccgggttacttggttcacgaatatcaaacacccagatatgtttctcgccatcttcttggttatccagcacggcctcatccagtactaccaataaatcacgatcagggagtggcaaagcagtatgagtaccgccgccaaagggggggctccaattacggtggcttattagtttcggttcgtgacgatcactgacatccaataaggttaggccaccatcacgccaactgccgtaagcggtatcgccactaataatggcatgatgcagcgcatagcgtttgcctgctggccagttaggctgttcacctgccgcagtatccataccaggtaacgcatagcgcccggcaacctgtggcttttgcggatcagccagatcaatggtgaggaagatataatcgctataaccatctaacagtgccgatacatacgcccaacgcccaccgacataccagattcgatggataccaatgccatcaagcggtaagaaactgatttctcgtggcttgtctggcgttgaaatatcaaaaatacgtaaacccgcgctccaattgcggccttcctgacgcgtgctgactgtttcggcgactgaacgggtgtaatagactttctcttcggcaaaacgggcatcggcaaataggtcgcgtgcattaatcaccagcagcagatcatcatgagtttgcagatgcacattccaggtattcggaggcgcagcgatgaaacctgcgggacgcgggtttttggcatcccttacgtcaataattgatacgcctttcgataccatatggccgacataggcatagcccctatgcaccataacttgtacaccgtctggtttgccaccttggtcactgtgaccaatcagccgcatattgcggctgtattcaggtatcggcaaggaaccttgtgttgccatcaatacttactccaaatctattgaccattttgggctgcaagggtcgcaaaccaaggagagttgaaatcatcagactgaccccaaccggggataatcttacttaaacccgccacattaaccgggccaggttggctggctagcaatgcctgaggaatggaagccgcgcggaattcatagctggcaggtgtggtttcccccgcaattttcttggcaatcaggcgcaggttaatggcgccaattagcttaggatctaccgcaacactgactttccatgggctattagcttcgcgcataagttgtaagtcttgattcgaaatatcaatgctatacagttttatctcagtgcggccattttcttgtaaggctttataagcgccctgtgtgaaggcatcccaagttccccagattgcatctattttaccttttgggtatttcgccaataccgcgccgactttattggcggtatcaccctgaacatcagaggaaactgcaccgatagattccagttcaataatcccaggattctgctttagcaatgcttgataagcggcttggcgcctttccattggtgggaaacctgcgacccaaagcttgataatattggcgttaccatcgaagtctttgattaactgaccgaaggattcattggttaatgaggcgtcatcctgttgagtgactgtcagccccggaatctcgccctgaatagcagtgtcaaataccgatacggcaattccattatcggtaatgcgctttaccaactctgttgagtaggggtcgcggccctgagaaagaatgataccgtcgtatttctggctaatagcctgattgacaaagtcctgaaagcgagcgtcgtcgccgttactcagaaacgtatccactttgaagcccagctttttgccttcttttaatacaccggacaggaattgtgtcgtgttgtcatcggagcctaaattacggattaccgcaattttaatctgaccttgatggttggcgatagcgtccggtaccggagctaatgtgacggggtcagcagcaaataccggcagtgctgtgagtaggctcaaagccaatatagggtaagcgatttttttcatcaggaactccatcatggtgtcggtaagttatgcaatgtgttgttgttttataatgaccgttagtataggaatcatatagttacaggcatcatgtgtttgtaaatacttttattatagctatctttgcttctagacgtccgttggttcgagtctagcatcataaccataactattttgataatgaattaactttgttataagtttttcgatcacgttatatcttttagtttggatagcctaaataagcagcaaaaatggtcctgaaagggggggatggggtggtatcgcgtgagtaggcttgcttttaacaaggcttatatatttctcgttatctattaaatttatttaacttataaattcaaaagttaatatcttatttcgctaatggcgtagtgtgttattataaataaaatacaactgcaataatcatgagaatagatgtcaaacagcgcgtgaaagcgctcgttcatctgtgtattttctttgcttttgttaaataaatgactaatgatgtttaaaggattaaagtcaccatgggtaagattagcactctatgtaaatcaagaagggatgagacacatataacatggctaaattccaaaaaccataataatgatactgcctatttttatatatcgcgcagtgattttttattaatttttatccgatatttattcatattaattgttcttattatcgtcttggccgtattattacctgaatcacacgatgagttattacatgcacttatccgccttttacctgcgactttgtcactggtcctgctgctgccctgtgccgcgcgccttgctagtcaacggttgagccagtatctattggtttttcaccttttcccgttgatcacttgtttttcactgaatccattaaccatacctttatctggggcatttttactttatcttatatttattaatatttatgtcgatacgcccccgagttgtgaacgtaagaaacagcagtccaatatattacctcacgagtatccggttggtttaacactactttgctttagtgggttatatctgactttttttgtgtggtttgatctagatgatgcgattatctttttgatgtcgttatcgtggcttttctttttactgtccaagtggcgctggcaagttgtggcattaaatgcattaggcggtgttgggttgttttggtttttttcctctggttttgtggacataaagtatcataaaaatattattgttcgtgctctaattaaaatatctttactggacagtttgttatttattattttctcattaagcttatttatcaatatgttattttggttggaggagtggcagcgcacacggcaaccattaaaaaaagatgagtgagacatttttcgttggaaatgacgggtttcaatcataaaaatgccggtagggttaccccagaccggcattttgttctttaaggatctttcagttatctattgtatcttcgcttagtcgccagaagaaaatcacttcacttgcatgcctggctgcgcaccactgtcagggctaagcaggaagatatcgctacctccggggcctgcggtcatcaccatgccttctgaaaccccaaagcgcatttttctcggggcaaggttagcgaccatcacggtcatgcggccttccaaggcttttgggtcagggtaagctgaacggatacccgagaatatctggcgggtctcccctccaagttcaagtgttagttttaataacttatctgagccttcaacaaattcggcttgttgaatcaacgcaattcgcatatcaactttggcaaagtcatcaaaactgatggtttcctgaattggatcatcggctaacgggcctgtaaccctggttgcaggtgccatatcttctttagacgaggcgaccatttcgtttactttgtctaaatcaatacgattaaacagtgccttgaaagcggtgatagagtggcccagcagaggttgttcaatgctatcccaagttagctcggtattgaggaaggcctcggtacgctctgtcagagagggtaataccggtttcagataggtcatcaggacacggaataggttgatccccatcgagcagatagcgtgtagatcggcatcgtggccttcttgtttagcgaccacccatggagcctgttcatcaacatagcgattagccacatcagctagcgccataatttcacgaatggctttacctgactcacggttgttataagcatcagcaatactggttgcggcatcggtgaatgttttatacaacaccgggtcagccaattggtcagctaactggcctgcaaagcgtttattgataaaaccagcattacgtgaggccagattcaccactttattaacgatatcggcgttaacgcgttggacgaaatcttccagatttaaatcgatatcatcaatacgcgaagagagtttcgccgcgtagtagtaacgcaggcaatccgcatccagatatttcaggtaagtccccgccttaataaacgtaccgcgagatttagacattttcgcgccgtttaccgtgacatagccatggacaaacaggtttgtcggcttgcggaagttactgccttccaacatggctggccagaacagactgtggaagtaaacaatatctttaccgatgaagtgatagaggtcagttttggcgtctttaccccagaattcatcaaaatccaggtcaccacgtttatcacataggtttttaaacgcccccatgtaaccgattggggcatctaaccagacgtaaaaatatttacccggtgcatccggtacttcgaaaccgaaataaggggcatcacgcgtgatatcccactgttgcaggccggaatcaaaccattcctgcattttgtttgcgacttgttcttgcagcgcacctgagcgtgtccaggcttgcaacatgtcactgaaagccggtaaatcgaagaagaagtgttcagattcacgcatcactggtgtcgcaccagaaacggcggatttggggtcgataagttcagttgggctgtaggttgcgccacagacttcacagttatcgccgtactgttccggggctttgcattttgggcaagtgcctttcacgaaacgatcgggcagaaacatgcctttctcaggatcatagagctgagaaatagtacggttctttatataaccgttggctttcagacggccatagatcaggctcgacagttcacggttttcatcactgtgggtggagtgatagttatcataactgatagcaaaaccggcgaaatcctgttggtgctcctggctcatttcggcaatcatctgctctggttcaatacccatttgctgagctttcagcatgataggagtcccgtgggcatcatctgcacagataaaatgaacctggttgccgcgcattcgctggaaacggacccagatgtctgcctggatatgctcgagcatgtggccgagatgaatagaaccgttagcgtatggtagcgcgcacgtcaccaatatttttttcgcgacttgagccatagtgggaaattgctttctttatgttgattaaagggcctttgatgttaaccgataagcgagtttgccgctagggcaagggagcgggtactgcaccttaagtctgaaaggttctgctggtggattttgataatgcagccattagccatcaggattatgcatacatattacgtattctctactgtagactcacacaggtgtggctgagttctggtacactaatgaatgttgtttttaggttgataacgataatttcaaggagccgggatgagcgaaaaatcccccgagcagacaacacctggcctgctgcaatcacaaattttaaaggtccttacggccttcacccatccgaccttgcaaaaggatctgaacacactgcgcgccattcatcactgtgccttgttggacaatgtgttgcatatcgagctggtgatgccttttgcctggcaatttggttttgaaatactgaaagaatcggtcagcgaagagttactggcggtaaccggtgccaacgccattgactggaaactttctcataacatcaccacattacgccgtgctaatgatcaaccaggtgtaaaaggtgtacgtaatattttggctgtcagttccggcaaaggcggggtgggtaaatccagtactgcggttaacctggcactgtcgttggcggaagggggcgtgaaagtgggtattcttgacgcggatatctacggtccttctattccaaacatgctgggtacgatgaatcagcggccaacatcgccagatggcaagcatatggcgccaattatggcccatggtatggcaactaactcgattggctatttggttactgaagagaacgccatggtgtggcgtggtcctatggccagtaaggcattgatgcagatgctgcaagataccttgtggccggatttagattatttggtcattgatatgccaccgggaaccggtgatatccaactgacgctgtcacaaaatattccggtgacgggagcgttggtggtgaccacaccacaagatattgccttaatcgatgccatgaaaggcatcgtgatgtttgaaaaagtgcatgtgccggtgttgggcattgttgaaaacatgagtatgcatgtttgtagcaattgcggtcatctggagcctattttcggtaccggtggtgcggagaaactggctgagaaataccattgcaaactgctgggccagatcccgctgcatatttcactgcgcgaagaccttgatcgcggcgagccaacagtcgtcagccgtcctgatagcgaatttactgatatttatcgtcagttggcggctaatgtcgctgcggagatgtattggcaaggcgaggcgataccgacagaaatctcattccgtgcggtgtaatggcagttttcgctgaattgagcgcgtaacacactgagccggaaaggtcattcaatgatgcttccggctcaagatcggcttaaatagccagagattgcctccttccttggtattattcttctatgtggccgccaaagccttgccttagcactggtatcacacctgctaactccttataattgccgctcgaagcacttcgtgtgctttgtctcccttcacacttcgtaatcaggtctttaattttatgactgacaaagcacatcagtgcgtcattattgggatagcgggtgcttctgcctccggaaaaagtcttatcgccagcacgttgtatcgcgaattacgtgaacaagtaggcgaccaacatattggtgttattcctgaagatggttattacaaagaccagagccatctgtcaatggaagagcgggtcaaaacgaactacgaccacccaagcgccatggaccacaatttattgttggaacatttgcaggcgttgaaggcgggtaagcccgttgaattgcctctgtacagctatactgagcacacacgtaaaaaagaaacggttcatttagaacctaaaaaagtgatcattcttgaaggtatactgctgctgacggatatccgcttacggcaggaaatgaacttctcaatcttcgttgataccccattggatatctgcctgatgcgcagaatgaagcgtgatgtcaatgagcgtggccgttcgatggactctgttatggcccaatatcagaaaacagtccgtcctatgtttctgcaatttatagaaccatctaagcaatatgctgacattatcgttcctcgtggcggtaaaaatagaattgcgatcgatattctaaaagcgaaaatcagtcagttctttgagtaacgttcgtctggacctttgctcctttatatgacagtttctgtggtctatggcagtttttgtagcatacacgctgtaacatgcgaattattatggagattctagcaatgagactgtgcgatagggacatagaggcctggctggatagtggcaagctaggtattgaaccgcgccccccggtagagcgaatcaatggggccactgttgatgttcgtttaggtaatcaattccgtgttttccgtgggcatactgcggcatttattgatttaagtggcccgaaagatgaagttagcgcggctctggaacgggtaatgagtgatgaaatcaatcttccagagggtgaagctttctttttgcatccgggggagttggcgctagcggtcaccttggaatcggtcaccatccccgatgatttggtcggctggttagatgggcgttcttctttagcacgtctcggattaatggtccacgtcacggcacatcgtattgatccaggctggcaaggccgaattgtgttggagttctataattcaggtaagttgccattggcattgcgccccggtatgttgattggcgcactgagttttgaacctctctccggcccggcggcccggccttataatagccgccaagatgcaaaatatcgtggccaacaaggggctgtggcgagccgtattgataaagactagtgaggttattggcaacgcgatttatagctcagagagtggagggttgaccgtaccttagggacgttccggtggctgacgccacttacaatcccaacggttcgctttcccttcatttgacttggtcagcagtctggactagtcattctttttattgagaattttagcctgtttggacaagaggacgtcatgagacgattactgacaatgttagttatcctgctaattgtgttagttgcaggtatgagcgcattagtgctgttggtgaatcctaatgattttcgcgcctatatggtcaaacaggtagagaaaaagagtggttaccacttgcagttggagggtgatttgcgttggcacgtctggccgcaactcagcattatcgctgggcgcatggcgctaaccgcacctggcgcactagaaccggtggtcagtgctgaaaatatgcggttggatgttaaactttggccgttactgtcacatcaactggatgttaaacaagtgatgttgaaaggggcggtgatccgtttgacccctgacagcgaggcccagcaacagatagatgcgccggtcgccccaattgcacctgcgggcagtacgccagtgagcgataaccgtggctggacgctagacatcaatagacttcaaatcgcggacagtttgcttatttggcaacgttctgacaacgaccaaattaatgtccgggatatcaatctcgaactcaagcaaggcgggcagcgtcaggtgcaggtcactcttgccagccgtgttaaccgcaatcagcgggacttaactttctcaatggtcattgatgccgatatgcatcaatatccccgacagttcagtgccaatatcagccagttcacttataaactggaaggggctgatattcctgcaggggggatcagtggtggaggggcgttggaagccagttatcagagtgatattcagcaattactacttaatcagttaaattttactgccaataataaccaattggctggcagtgttaaggcgacctttggtgatgtgcctgactacgtggttaatttgacctctgataatctcaatcttgatgcgatctttggttggcagccgaagagttcaacagccagtaccgacgaagccaaacagcctgtcacgacagcaccggttattgctattcagatagatgatgatgtagggcaaaatttacaagcattacgtgattttacggcgcaaacgacggttgttgccaataatgtggtttatcgcaacattaacatcaaccagttgaatttacaggcaactaaccagcagggtgacttacaggtaactcgcctaaccggtaatgcgttggagggggacttctcactcgcgggggcattggatgttacgggcaaaaaagtgttggctacggtgaatccgctgataaaccatatggaattggggccagtattgcaggctgcaggtttaccgcaggtaatgacgggtaagttttccatgcaagcgcagttgtctggagatggtgtgaatctcgcagcatttaaacatcgctggcggggggaagcgcaagtcagtatgaataatgcccggttacagggcctaaatattcagcaattgattcaacaggctgtcacacgtagtaccaatgatgtcaaaggtcaggaacgctatgagcgatacactgaggttaaacaactgcaagcctctctggcgctgaaccgaggtgcagtgaaagtcagcggcctcaatgccagttcgtcgttaatttccgttaaaggcagcggggggcttaatctcccaactcagcaatgtgacatgaatctagctgtacgcgttatgcaaggttggaacgggcagagtagccttgtcaaaacattacaaaatacagatattccgttgcgtatttatggcccatggacccagctcaattatcaattgaatgttgatcaattgctgcgtagtgagttacagcagcgggccaagaaagcgttgggggagtgggctgaacgtaaccaacaaaatcgccgtgtggacgatctgaaaaagtcacttgataagttgtaagccatccatcggaaacagagggtggaaacaggtagtggaaataggtagtggaaagagataggcccgatggtttctccaccgggcctaatcatttatttttccaggcttttgttaattcacctaatctatagcgttatcaattaactacacttcgtaatctggctcaggaatcttcaatggtgttatcttcacttttaagatcctgtggctattgaccaccagaggttcgaataagtaatcgccaatggtcagttgttcacctactttgggtatcctctgggtatgctccatgagtaacccggccagtgtgtggtattcacgtttttcatcaattggcagcggcaaatagagcaccaaatcttccagcggcatataaccgttcgctatccaacagccatcttcagtttgctgaatatcgtggcgcgcatctaactcttcccctgctacgggtaagttacctgcgatagtttccatcacgtcggtaagggtcacaaccccctcaatagaaccgaactcatcgacgacaaaagcaaaatgtgtctgtgcctgacggaattgttccagagccatcagcaatgaaacttgctcaggaaagataagtggttggcgaattaatgaccgcaagtcgagtttttcattcgctaattgttgtttcaataaatcaattacgtgaataactcccaaaggttcatcagtagagctatcttcagtaaccacgatccgggtatgcagatttttcgccagcaactgagtcaatttctctggtgggtcattgaggtccaaatattcaacatcatggcgtgatgtcatgatgctactgacggttcgctgtgccagccctaagacccgttcaatcatgcgccgttcttgcgcattgaacacttcctggccttcgctggtattatcagcgatcagattggcagtatggttatccaattcagcttcttcgtgtttgccactgagcatccgtaaaacggcctctgcggtacgttcgcgtaatggtctaaccgttgacaggaagcgccgacgattgaattgtgcaaactggttcagtgactcaataattactgagaaaccaatagccgcgtacaggtagcccttaggaatatggtaaccaaaaccttcagcgactaagctgaaaccgatcatcagtaagaagctcaagcacagaatgacaatcgttggatgtgcattgacaaagcgagtcaacggtttactggcgagtaacatcaagccaattgcgatacaaacggcggccatcatcaccgcaaggtgatcaaccatgccgacggcggtgatcacggaatcgagcgagaagatagcatccagaaccactatctgtgccaccaccggccagaaacgagccgctttgcgttgctgattctgctgatgatctttcccttccagccgttcatttagctccatcgtagctttgaacagcaggaatattcccccgaccaacataatcaagtcacgtgcactgaacgaatgttcagagagagtgactattggtgtggtcaatgtagccagccacgaaatacaggccaacagtgccagacgcattaacaatgcgcagagtaaaccagtgactctggctttgtctcgttgatgacgaggaagtttctctgccaagatggcaataaatataaggttatcaatacccaatacaatttcgagcacaaccaatgtagccagtcctgcccaaatagttggatccgcgatccattccatatatccagtttcaccttgtattgctacggcttatgccgtcaatcagaaaaatagccatttgttaaagaagtgcatcgaccagagtcgatcacaaaaaaatcaatccaagctaaacgattcgaacattagccaggcacaacaagtcattagccgagcatagcgaatcactaactggactgagttatgctgatcatagcactgataattaaaaatgaatgacggaagatatagaaatatgccagatatcaatcatattgtagggagattcggctatgttatcatgatgttctgtttgactattgttacaaaatattttgtacacccccttcttgaaataaatttatataagtaacagaatgcatttaaacgataatgctattgataatcactatcattctgtatgataatgttttcatcattttatccttcaggaggtaacaggtgtcaaatacagcacagttaattacaccttcccctatagggctaattgcggatataacagaactttttgaaaaaacgttcgcacatttctccaggacattaaaagtaaatgctgatgatatccctgaagaaacgatgagtttccatacttggtcaagtattgataatttccctacgttaatacagaaatatagagatgaatattatggggataatgatctaaaacccaacgataaagccctctattcattatggagtcagtggtattttggtttgattattccaccaatgatgttgttattaatagagtatccacagactattgacacacaccacaaaaattttaaagtgttgtttcatcacagtggcagacccgaagtggtttattatcaattaaagtggcaaagtcaagatccgggtaccttgcttgagcgttattatttactgctcaatcatcatgttattcccatagcagaaaaaattgagtcttaccaaggtataaatggacgcttgctatggaataacattggatacctgatgttctggtatctaggggaatttaaaggccgcttaggtgatgatctctatcaatctattattaatgggcttttcatggagttatctttgccgaatggtcaagataatcctctttatcggacagtgatattacgtaatggcaccttacagcggcgtagttgctgccaacgaaataaattacccggcgtcaggagttgccatgattgtccgttagaaaaatccccattaaatcttattagttagccaagttcctccattagacagaaacttggttgtattctttattttattccgcatttatatctacgtcttatatttatctacagttaattataataaaaaatataataaatatagcgtcactaaatgccactttatatttaaggatatattatgtacaaagatatctatgaggaaaaccattttatagatcaaggtaatgatataactgatgtgctttgtttaggaaacttcttaaataaagatagcgctgaacactattatgagagcgtgaataatatcactgcaaggattaaggctatattcaccctagtagataaaccttttagcgggatattaccctctgaactatcacctgatttttattgtattgatttaaatcagccactaacgtcattggatagcgcattagatgaattacagcagctatatattaaggatgctatatactttcatcaccctaaatatgttgcgcatcttaattgcccggttgttctccctgcagttctggcagaaagcattattagtacccttaattcttcgttggatacctgggatcaaagtgccggtgcgaccttaattgagcagaaagttctggattggacccgcgataaaatggccctaggtagccagggcgacggtattttcaccagcggtggaacacagtcaaatcttatggcgatactgctggcccgtgatcatttttgccaccaacgtgatgctaaccaccagaataaattgcagggattacccgctgattctcataaatttcgtatctttacttcggtggttagccatttcagtacacaaaaagccgcagcactattgggccttggctataacgcggttgttgccgtgccctatgacagtgaattcaagatggatgcgcaggcattggatcaaagcattgcgctctgtttatcacaaggcaatattcccttagccattgttgctaccaccggaacgactgactttggcagtattgaccccttgcacactatttcgacgttggccaaacagtacggtctttggttacatgtggatgctgcctacggctgtggcctattagtttcctcacactatgaacagctactttccggtattgaaatggctgattctgtgacggtggattatcacaagtccttttttcaaccggtaagttgcagtgctttttttgttaaagataaacagcatttttcttatctgacttatcacgcggaatacctcaatccattaagtgcatcactggaaggtacgccgaatttagtgaacaaaagtattcagaccacccgtcgctttgatgcgctaaagctgtggttaacgctacggattatgggagccaaacagcttggtttggcttttgaacatgttatggatacggcacagcaggcttatcaacttatgttgcctaatccgtattttgaactaatacatcgcccggtattaagcacgctggtatttcgttttatgccggaacagcctcgcagcgatgacgatatcgatcgaaccaatgcctatattcgcaaagcgttattccgtgaggggcatacggttattgcaggtaccaaagtaaatggtaaacagtatttgaaatttaccttccttaatccgacgaccacactccagcacctgaacgaaattgtggatgccattattaccgagggtaaaaactatccgactctctataacagtcaatcatgagattgatgttgtttgatcaggagtaattagaacaatgcgaccttatgactttattggcatcggtattggcccgtttaacctcgggctagcatgtttaacccaaccactaaatgatgtttgctgtttgtttatcgatcagaaagcaggatttgattggcacccaggaatgatgctggaaagtgcaaccttacaaacgccctttatgtcagatttggtgacgttagcatcgcctacgcacccattaagttttttaaattatatcaagcaacaggggcggatttactccttttatattcgggaaaattttttcctattacgtaaggaatataaccagtattgccagtgggcagttgagcaattacctaacttacggtttaacacgcaggttgatgacattcattatgatgaagacaccgcgctatatcggctgtactgttctgatacatgctcaggcagtcgccatgagtttctgtgcaagaaactggttctgggtaccggcccctcgccacatatacccgaatgttgccaaccttttattcagcaaatagtgatgtccggccagtacctggaacataaagtggcgttacaaaagaaacgcgctatcactattttgggcagtgggcaaagtgcggccgaaattttctatgatttgttgtgtgaaatcgatcgctttgattaccagttgaattggcttacccgctcaccccgattcctcccactggaatataccaaactgacgttggaaatgacctcacctgaatatgtggactatttctatcatcttccaccagaaaaacgtgatgagctgaatctcacccataagccattgtataaaggtattaacggcacattgattaacgatatcttcgatctgttgtataccaaacgtctgaacggtgctctcaatgtcaatctgtacaccaacagtgaattacagaaggtgagttcgagccatgatggcaaggggttgcacctgtcagtgttgcagcatgaacagaatcaattattcacattggagactgaaggtgctgttttggcgaccgggtatcactatcagccgccaacttttattgaaggtatacgtcaacatattcgttgggataataaagggcgctatgaggttcagcgtaattacagcattgatcggaataatacgatttttgtacagaatgtagagctacatacccatggttttgtgacgccggatctcggtatggcttgttaccgcaattcttgtctgattcgtgaaataaccggtactgaatattatccgattgagaaaaacattgcttttcagcaattcagtgcgccatcactgaggaggaaagagtgatgaacgctgagaggaatattgagagcgataccgtggtgaggagtggtggttttcaactccgcccgctggtgttagcacatgatgtcacttggctgacggattgggttaatcgtgaatatgctcactattggggaatgcaaggctatagcccacagcaggtaaaggcattttaccaagaattgaatacgagccagcctggcggtgtctttgtgggcgtttatcagcagcagcccgcattcttgttagagcgttacttggcccaacatgatgtgattgccgattattaccctgcacagcctgatgatgttggaatgcatattttggtggctcctccggttgagagaatcacgggttttacctggcgggttttccaggccattatgacctttattttcagcgatccaacggtcgcccgcatcgtagttgagcctgacgtgcgtaatgaaaaaatccatcgcttaaataaacgagcgggttttgtctatcaacagcaactgacattaccccataaaaccgcttggttggcgttttgcacccgggaacaatatcgccttgccttacaaaaggagcatcaatgatgatggacttatcagcgcctctctccccgcaccagagtttggaactcccccatttgcagccggtactgtggcaaaaagtgaatcgcttgcacttgtgtaaagctatttctgagttttcccacgagtgcttgttggctccccaacggatgacagatcaccctgatagtgagggatatgattactatcagttggtggcggcggcggcggacaagccggcgaactatgtttttcgtgctcgtcgcttggcactggatcactggttgattgacccagattcgttgcataaaaccgttaatgaaaagagcacagatttagatttactgttatttatcattgagttcaagcggcaattgggcatcagtgagcgagtattgccgacctatttggaggaaattaccagcacgttgtacagcagcgcatttaaacactgccgcacagggataagtgctaccgccttggtgaatgccagctttcagataatagaaaaggaaatgatggaggggcatccttcctttgtcgctaataatgggcgcattggttttgatgctcaggactttcagagatttagcccggaagccgcatcagatgtgcatctggtctggctcgccgcccataaaagtaaggcgcattttgcctgcattgaacaactcgattacgcgaagttgatggaacaggaactcggggcggaggttctggccgaatttgaacagcaattaatagccagagactgtaatcctcaggattatgtgctgatgccggtgcatccgtggcagtggcagaataaactgacttcgatattcgcggctgatattgctaatcaaaggttggtatttttggggcagggcaaagatgtttatcaggcacagcaatctattcgtactttctttaatcgcagccacccgcagcgatattacgtaaaaatggcgttatcgatcctgaatatggggtttatgcgcggtttatcaccctactatatggcaacgacaccaggaattaacgaatggctgtttgacttggttgaaggcgatgaaatattgcaagcgtatggtttcaagattttgcgtgaagtggccagtattggttttcgcaatagctattatgagcaggcgatcactggggattcagcatataaaaagatggccgctgcactgtggcgggagaatccgctgcaattaattcaacccggtcagcaactgatgacgatggccgccttgttacatttggatcaagaagggaaagcgctactgcctgcgttgattgatgcatccgggttatccactcagcaatggctggaacgttatttgcgtagctatttgtcaccgctattacattgtttatatgtttacgatttgatgtttatgccccacggtgaaaatatcattttggttctacagaatgccgtgccgcaacatattttcatgaaagatctggcggaagaaattttggtgctgaacactgaggctgatttgccggagaaagcccggcgcatcatcgtggatatgcccgatgagatgaaaaccctgacgatcctcagtgatgtgttcgacggtgtattccgctatttagccgcagtcttggatcaacaaggggattatcctgagcgctatttctgggcggatgttgcggcctgtatccgccagtaccagcagcagtatcctgaattagccgctaaatttgcgagctatccgttgtttacacccaaaattaaacgctgttgtttgaaccgcttacagctcaacaataaccagcacatgctggatttagctgaccctgtgcaaagttttcagtttgctgatgatttgatcaatccgttggtagaattcgaggtatcagcgggttagcgcttaataaattagtcggtcgttaataaaccaataggccgttataagcagtcgaccgttataaaccaataggccgttataaaccaatagaccggcaccgttgaggagcctttcagggcggatgagctaacgcgactgacggcggggtatcaccaaaggcttgccggattcagggtcagtaatgatccggcaacgtagcccaaaaacggcggcaatgctgtcttcagtaacgatagattctggtaaaccttctgcataaatttgcccctctttcaacataatcaggtgggtggcataacgcagagcctgattaatatcgtgtagcaccaataccagcgttttcccctgttgttgcagttcttggcataaatccagcatttcaatttggtgcgcgatatccaaatatgtggtcggttcatccaataaaacaatcggtgtatgttgagccagtgtcatggcaaaccacgcacgttgccgctgaccaccagagagttcactgactctctgctgcaccagactctccagattaacggcgctgatagcggcttttacgatacgttcatcttccgtcgaccattgatgaaagaatgattgatgggcgtaacggccacgggaaaccagatcaaacacggtcaaggtttcagaaatacttgcgccctgagaaagtagcgataactggcgggcaaagaccttggctttgtagtgctgaatatcctgttgatctaacctgatactgccattttgtggtaacaagctacggctgagcgctcgcaacaacgtcgatttaccacaaccgtttgggccgataatgacgctgaacgcgccgtttttaatgctcaggctaagcttattgataataagttgctggccgtagcccagtgacagtttttgggtggttaaacgcggtttatcactgatatcgcccgggttctccaatggtgtcatgggggatgttagctctctttgggatctcactttgttttcctcactttggcgtatagcaagctcatcagataaatccccccgacggcagccgtaataacgcccacggggagccgtgaagatgttggtaatagcaaggttatgatgtctgacgccaataatagaaatgcgcccatcaaggcggtacataacagggagatgccgttagcctttaccagatgttgggtaatctggggggctgacagggcgataaaggcgaccggcccgacaaccaataccgccgctgttgccagtgcgatggcaaccaatagacctagccaatgcgtctggcggatattgacacctagcggctgggcaatcgcggctccaaggctcaggtaattgagttgacggctgagatataccaagcccggcataaccagtcccaatgtcaggctgatgatgccgacatcccgccagtttttctctgccaaactgccgctgagcaaagcggctaactgactcgcctgttccagacggacttgtgaagtcgcaaagttaacaaatgcgatgcacacggcaccaacggcgataccggaaataataattctctctggatgagacaggatgctcatgctgcccgcatagactaaagccactgcagtacaggcaccgataaatgcccccaacggtaccggcatgacccctggccaaagtagtagggtggcaaccacgccagcggacgcgccggtggtgataccgataatatcggggctagccaaggcgttgtgggttgtggtttggaaaatagcgccggaaatggccagggcggcaccggcccccagagcaaccaatgctcttggtaaccgcaattgcagtaagataaactcctcgtactggctaccttcgccagccaataccgccagcatttttcccccttcgaaaccactggggctgagcattagcgcagcggtgaggcatagcaataaaatgggccatatcagcagcaggtaaaccccggttcggcgggctggcgctaaaaagacccaagatcccagcgtcagcgttctgactgaatcaacgggatgcatagacgataccttttttactgttgaccaccgcgtaaagcaatggccctcccacggcagcggtgatcacgccaaccatcacttcgccgggggcgatgataatgcgggcgaccacatcggcactcagcaagaggattgggccgagcagtaagcaataaggcagtagccaacgaaagtctgagccaatcatggctcgccccaaatgaggggctgccagaccaataaaagcgaccggacccgctactgccgtcgcggtagcggccagcaatgttgcgcctactaatgccgacatacggatccgaacggtattggcccccatggtggtagcaacgttttcgccaaataccatcacgttcagcgaaggggcgatggcgaagatgatcaccaaaccgatgacaaaataggggagcacggccagcatggctgatactgatgtcgccgccagagaacccatgatccagaagcggtaattttccaacaccgcagggttgagtaacaccaccccctgtacataggcaaacaggcaggcattgatggccgcgccggtaagcaccaaacgcaccgagtgcgtattccgttgcccgccccccaacagataaaacaacagggtggctagtgctgcaccgagtagggcaggccaaaaatgcggtattgctgccagtgcggggaagaacgcaaaactgacgataatcgctgatgcaccggcattgacacccaataatccggggtcaccaagtggattgcgcaatagcccctgagtcactgcaccggagagggccagtgcagctccagccaataggccaatcagtgtacgggggatccgggcatcaatgaccagatcgttatagctgatatgagcggcgggcatattgatgtagtacatctctatatagtgccagattgcgctgattggcaaggtcttcgccccgagagtcaggctgactaacacacacattaatgtgagcagcaataaccctatccatcctaagatgcggtattttcgtaattgttgaaccgtgttatctatcatggcagtgtctctttggtatcagccaagtggcgcgctttttctgcgagcaatggcataaagcgttgcaacccccactgaacgctcagcggtgtgccataggacatcgccatgacaatcgcttggtcggtcagtgggatatacccgccgcgttgcacggcagccatcgcgttgaataagggcttttcttcaacccgctgccgttcttgctcgctgctataccaggtgactaaaatatcggcatcatccaactgatctgcattttccagcccaagattagcagcaaagctgcctcgcgatgccatgaggtctttgatggatggggcgagttgcatacccgtggcgattaaggtgtcaacccgtgggtcgcctgcgacatacaccgacaagttggtattgctactggccgctttaatgtaggcaaaacgcaggtttttaatccccggaaccgtttggcccgcagcggataaggtgttttttaactcttgcaataacgggtaggtttgtgactcttctccgagtgtttggccgattaattcaacttgttgtgtgaggctggtcagccacggccggccgggataagccacgacgggcgcgaagcgagatagttggttgtacaggctttggctcatccctgactgagtcgcgataatcacatcgggctttagattgattaactgctcaatatccaactctggatacatattaagcacctgaggcagcggctcgccccgttgttctaatgcttgtctgaaccaaggcaaataaccttgcttatcacctccccatgtgtgggattcaatacccaccgggatcttgcccaatgccagcacaatgtcttctgcgcctgcgccgagggccacaatacgctgaggtggacgctcaatgaccgccgtgccaagtgcgctggtgattttccgtgggaaaccgtttgcttgcgtggtgtgcacagcgccggtttcggcctggctatcgccgacagaaagcaaaaaaaacagcgcaagtagacccgctaatataaaagaaatatcgcctaaccagcggggggctaatgtggtgcaggttcgcgttttattcatttggtgtatccatatcgtgctttctgaagacgttggcaaaagatacagccggaaaagtgaccggctgtgagggtatccaactgcaatccttagaaggtgtagcgcacggtggcatcgacattgcgtggtgcgcctaacaagtattggttgtattggccgatttgtgtgtagtaatgctgattaaacaggttatccagattgaccgttaaggagagctgaggggtaaactggtagcggctcatcaggctgtaaatggcaaaactgccttgaccgatttgttgaataccgattgggctactgagatttctggcgatttggctttgccagttgacgccaccgccgagggtcagatcgcttagttgccccggtaaggtataggtggtgaagagttttaagactttccgtggtgtgactggggtgacaggtgtctgggtatttgagctcggtagtttcacgttgtactgggtatagcccgcagaaatattccagtcttcagtcatttttccactgacttccgcttcaaaaccacgggttttagtaccgtcgacggcgaagtaaggctggctgttatccggcaagcggggggcggtggtgtccggtacgggcatattattctgacggatttcaaacactgccagtgaataatcaagactattatcgaaggcaacacctttcaaaccggcttcgtaattctgcccactcaccggggccaataatgtgttattacggtcccgacggttttccgggttaaatatttcggtataactggtataaaccgacaaatcgcgattaatgtcataagtcaggccgctgtatgggacaaactcattcttataacgagcattttgtggcgtaccgaagttatcaccacgggtttcccaagtggtcaggcggccaccaaggatcaaggttaacgggtcaatcagagagagttgggtcaccacatactgagaggattgatcgctgcgccctttcgaaccataagcccgtttatcactccaaacaggcttaggatattgccagcccggctgggtgaaatccccaaggtcgggacaggttctggtggcattacaggtcgccagataatagtcgttatcaatattttgtcgttgacgattccagcccaaacccaactgatgttggcggccaaacaggctgtactgaccattgacttgaatatcgtaattttgctgacggcgggcaccatcaatcagtgacagactgcctggccgcatacctatattggtttgtgggtcgggataaccggtgggccacatcacgtcttggcgcagcttatcgttatcaaaggtaaaggtgcctttaatattccagccgttatcaaaattgtgttgcagactgctaaacagcgtttgagttcgggtttcggcggatgcccaatccgatgcggtggtggcggattgggcataatttgtccgcccaccagcgctgttaaacaggggaagcccaccaaacataccgccccgggttagagtccgttgtgtatcggcaccaaaggtgaatagggtattgggggtgacatctatctccaagataccgtaaaacgggtttttactttgatcatagcggttaacaaaagagttcttatcttcataagccgtgacaaaacgcccgcgcacactgccttcactattgagggggccggagatatctagcgccgtacgccatttctcccatgaaccaacacctgccgacacactgccgcgaaaatcctgtgtggggcgtttgcgcacaaggttaataacggcggaagggttacccggcccagccattaagcctgccgcacctcgaaccacttcaatacgatcaaacatatcggtatcaagcgtgttatcaccataattaaagcgggtatcgtaaaaggtggcgacgccatctcgcataacattattaacggccatgccacgagaggtaaaaccgaaacgatcactgtcaaactggcgcacactgatgccggtgatgttattcacggcactttcgacgctgttcaggttttgatcacgcatgcgctgtttagtcataacacttaccgactgtggggtttcccgtgctgaaatattcaggccagttgctgtcgacattgatgacgtgttgtagctgccactgtcttctgtgacgccagcatgacgcaatggtgatgccgtaacggttatggtggtattcgcagggttgttttctctttcttttttctgactattattctcgtcagtcgcggcatatgcacaacccaacaacgatacattagcagcaagcacccatgccgctggtttgatagtgtgtgtgcagttaaaacgcactcggcttttgccgtgatttttttctagtattctcatctaattattctcactaaataaaaatatgggaagtttgtctttatggtgttgtgaaaatgccagtcatggcgtttcaatatattgatttttaaaaaatataatggtctaagagcttggcgctataaaacgtgatacagccaattcaggtatgctgtaaaaacaggtatgtcgtaaaaacaggtatgtcgtaaaaaccgaacatcgtaaaactacggtctgaccacgtgggtcagtacgtggttttgaaaacatgaattgggttgactaaggtgccggcaaatttcagattcttctctcgatcatcaagatcgatcatttgttggttattcgccatttgcagccgattcagacaggtacgaacaaaatcagctttaaagagatcgaacttcttgaattttttagccatggcagggtgttgggcttgataggtatggatgcaatcagccaccaaccgccagaattggtgctcattaagactcaaatctttttgcagtaacggcgtgaggtaacggaagaagcagtcgaaaatatccagcaaaatataattgatcttcatatcgtctttgacggtgacatggaggaatttgatggcatctggtagacgaatatccccatttaaaatagcaatttcctcaccgatatccttcatcaagacatggactggaacgttactttccagtaccaacatcaggttttccccatggggcataaataccaagtcgtaagtaaagaaggcgtgtaatagaggcgaaagataggcatccagatagtgtgttatccatgcctttgcacttaaccccgatgagtgtaccaaggcggagactaccgagttaccggcattatcgctgtgcagtaaagaggccatcgtcattaaacgctggtggccaacaagttttggcatagggctttctcgccacagggccgagagcatttttttatggggattatctttaattaaagcggtttcaaaatgggggttgaaataccccatggcggctctttcgcagagtaaggtaaatttcttctgctgaaagaaagtatcttgcttaattaaatcgctaagccattcattaaccaatggcgtggttaccatgctatggggggaaagcccgcgcataaagcccatattcaaaatagataatgccgtcttaacataatttttgtgtggattagagagattgaaaaacgttcgaatggattgttgagccagataactatcttgcccttgtcctaaataaataatatcgttacgtgcaatatctgcagcaaagctggtggcaatcctttcatgccattgccaggggtgcaggggcataaagaaataatcttgggcggtcaacccgcgagaagttaaatactgagtaaactgttcccattggtaatcgcccaactcctcctgcattaattgtgggtagctaaggccggtaaaactggaaaatacggttttatcctgatgtactgcgatccagattaaattaattggatgggcgctttctggtgcataggcagcgtagtctgtaatatcaaaaccaatacggccattattcgcgataaaaacggggtggccctcgctcatcgctgtttctacagtttggtaattggcgtgaaccaattgcgtggcgctaaggttattatgatgatacttaaaagcgtaaccataaagggtactggagatttcatccaaatagacgggcagcatttcttctgagataccaagccggttgtttaattcaataatcagctgtaatgcatccagtagctgcgcgtgcccatcaagggttttggttaaggtgcttgggtcaatatccaggtggtcaagttgataacattttgctttaaaaaggtattctattcggtcttggtctggagtgaagctatagtggtgatagccatcctctggtgtaaccaagcagactggggcaatcaatttctcatgagtcagttcacgcagtattttccctactaaatgtgcattggcatgagaccaattttcaccattaagatgttggatattattttcattgaattgacgttgtgaaaccatctctatagtgtccctattagtagaggatgaattaattgaagggtaagccctgaattcctttatggtttaatatccatatgcaatttatgtacatatttaatgtgggtaattctaaaggtaaataaaatagtaaaggccattaccccattcaaggttaatcatatatatcaccacccctatccaaatgcaaatgattattatttatacaagactctaatcatttctttcgctattgagttatgtaatgtaacaacgttactggttttttaatttgttggcatggcggtatagggttaaggtgaaataaatatattgctttgttatctatagacttctacagagttaaaatacgatgaatatccctctaggataatagcgtcaggcgagttgggcaaaataaccatgttgatataaaaatagtcgaaatcaaacttggttataatgaaagtgttgttttagataacttattggtcttgttgctatttgcagtgggtgtgttgaattttcaagaagataggtacagtgtcattcggatgttgttctagagaaactttctggttatattatttcatatgttcacatcactcaataattgaattttttcttaactctcggtttctttattgttttttgttttaaaatacagtatcaattttttttactaaatgtatctgttgttgagaggtttattgatatttttaaaaggtaatcaagaaccttctgatgtaaactgatagaagataaatgaataataagtcaccactgattgtctcacctggcttacagcattaatcaccctctgtgacacttaaagtcattagcgttacgggtaggcagcactgatgaactggcttagaacagtgattcggatgaaagaatgtggctaacagcgctgtaacttcaggtaagaaggggacagcgactcaaaattgaagaggtcagagtcatgaagtgtttaaaagccgtcattcctgttgctgggcttggcacccgtatgttgcccgcgactaaagctattccgaaagaaatgctcccggtcgtcgataaacccctgatccagtatattgtggatgaatgtgttgccgcaggggtcaaagagatcgtactggtgagccattcatctaagaatgcgatagagaatcattttgatacttcatttgagctggaagccgcgctggagtcacgggttaagcggcagttattaaaagagatcaaaaatatttgcccagcggatgtcaccattatgcaagtgcggcagggccatgctaaaggtctagggcacgcagtgttatgtgctaaatcgatggtgggggacaatccttttatcgtcatgctaccggatgtactactggacgattcaacggctgatttatcaaaagaaaatcttgccagtatgattaaacgcttcgaagaaaccggtcatagccaaatcatggttgagccagtgcccaaagcggatgtctccaaatacggtattgcggattgtggccatgtggcattagcgccaggcgaaagcacgttgatgacagcggtggtagaaaaaccctctatagccgaggccccgtctaaccttgctgtagttgggcgctatgtattgtctaaaaatatctggccgttgcttgagaaaacaccacgcggtgcgggggatgaaattcaactgaccgatgccattgcgatgttaatgcagcaagagcccgtagaggcatttcatatgacgggtaaatctcatgattgcggcgataaactgggctatatgaaagcttttgtgacttatggtgttcgtcatcatactgaaggtgaaaagtttactgcctggctgaaacagcaactcgattaaaaaatatcttgtcaggctgagtgttattgtcaggctgagtgtatgccgatttttaatttagcgtagagaatctgtaggtaagcatgaccaaattgaaagcagtcatccctgtcgctggtttaggcatgagaatgctcccggcgaccaaagctattccgaaagagatgttgccaatcgttgataagccacttatccagtatgtggtgaacgaatgtgttgctgcgggcatcaacgaaattattctgataacccattcatccaagaacgccgtagaaaaccattttgatacttcctatgaattggaagcgatgctggaggcccgtgttaagcgccagctattggatgaagtgcagtcaatttgcccaccgggtgtgacaataatgcatattcgtcaggggcatccagaggggttgggccacgcggttttatgtgccaaaccgttagtgggggattcgccatttgttgtcttgctgccagatgttctaattgatgatgagcaatctgatttaacccgcgataatctggctcaattagtgcaacgttttgaagagaccggggtcagccaagttttggttcattcggtagatcctgaaacgctgtctaattattcggtggtttcctgtgagaaatcgaccttgttgccaggggagagcagccggattaatgccatgatcgagaagccacaaagttcggcagatttacaatcaaatctgtctgcggtggggcgctatgtactgtcagcgcatatttggccattgttggaacagacgaaacccggcgcttgggggcgtatccaactgaccgatgctattgatgctttggctgcggtagaggcggttgatgcggttgccttaaccggtaagtcctataactgcggtgagaaactcggctatatgcaggcttatgtggcttatggtttgcgtcacccacagcaaggggctgaatttaaggcatggctaaaggatttcgtcgcgtaaattcaatctacgataacgggtatatagacgataggtgtatatacgataattaaaaagcaatccttggcagtttaggccgcgccatttgtggcgctttgctctttgcctatcctcaccgttctaaaagagcgttatcgggggctgccagcaatctgaggcaatcctcgcgatagatctttgtacaaactggcaggtggatttgcatttattggccgataacctcgcgaaagcaaacgtgtgcgcacagcaactagtcagttgtgctatctatcgcaccaatcactacccagctgacataatcctgagttaacatgtttcccacatcaaaaacctgttggccttaaggctggtaacaggtgtcatccttcagacaggagtttttttaatgtccaaacaacagatcggcgttgtcggtatggcggtgatgggccgtaacctggcgctcaacatcgaaagccgtggctattccgtttctatttttaaccgttcatcagacaaaaccgacgaagtggttgccgagaatccaggtaagaatctggtgccgagttataccgttgaagagtttgttgattcactggaaaaaccgcgccgtatcctgctgatggtgaaagcgggtgaagcaacagataaaacgatcgcttcactgacgccgcatcttgataaaggcgatattctgattgatggtggcaatacttattacaaagacaccattcgtcgtaaccgtgaactttctgcacaaggctttaactttatcggtaccggcgtgtctggtggtgaagagggtgcattgaaaggcccttctatcatgccgggtggccagaaagaagcctacgaattggttgccccgatccttgagaaaattgcggcccgtgctgatgatggtgacgcctgcgttgcctatatcggcgctgacggtgctggccattacgttaaaatggttcacaacggtatcgaatacggtgatatgcaattgatcgccgaagcctattcactgctgaaacagtctctgggtctgagcaatgaagagctggccagtacttttgctgagtggaacaaaggcgaactgaacagctacctgattgatatcaccaaagacatcttcaccaagaaagacgaagacggtaactatctggttgatgtgatcctggacgaagctgccaacaaaggcaccggtaaatggaccagccaaagttctctggacttgggtgagccgttaacactgatcactgaatctgtgtttgcccgttacttgtcttctctgaaagatcaacgtgttgctgcctctaaagtgttgactggccctaaagttcagcctttcactggtgataaagccgagtttatcgaaaaaattcgtcgcgcgctgtatctgggtaaaatcgtttcttacgcacaaggtttctctcaactgaaagcggcatctaacgagaataactgggatctgaattacggtgaaatcgcgaagattttccgtgctggctgtattattcgtgctcagttcctacaaaaaattactgatgcttatgcagaaaacgcagatatcgctaacttgctgctggcaccgtacttcaagcaaattgctgatgaataccagcaagcgctgcgtgatgtggtgtcttatgcggtacaaaacggtatcccaacgccaacattctctgctgcgattaactattacgacagctaccgttcagccgtgctgcctgctaacttgatccaggcacagcgcgactatttcggtgcgcatacgtataagcggacagataaagaaggtgtattccacactgagtggatggcgtaatccctttaacggcgactgtgctttgccattctgggatcgcgcagtgctcgggtgcctcacgtattgcgtgtacgctccgggcgcggttgacgtcatagaatttaagataccagcgactcatccgttttaacgctgcccaataaaaacgcctccagtgataagttggaggcgttttttgtgcccagaaaacccccagctaggctgggggttcagtaaagctttcagctttgggtcagttataaaaaccccttttgatttgttaaaacagtttgcggtctggcaactgcaaatgttcaacaagaaatcaaaagggggtcccaatgagggatgaaaagagcttagcgcacacccgatggaactgtaaatatcatatagtttttgcgccgaagtaccgaaggcaggtgttctacagggaaaaacgcagagcgattggcagtattttaagaaaactgtgcgaatggaaaaacgtgaatatcctggaagcagaatgctgtgtggatcacatccatatgcttctggagatcccgcccaagatgagtgtctcgggatttatggggtacctgaagggaaagagcagtctgatgctttatgagcagtttggcgatttgaagttcaaataccgtaacagggagttttggtgtcgagggtattacgttgatacggtagggaaaaacacggccaggatacaagaatacataaagcaccaattggaagaggataaaatgggtgagcaactctcgatcccgtatcccggtagcccgtttacgggccgtaagtaatccatagatgcaaatgtcagatcgcgatgcgcctgttagggcgcggctggtaacagagccttataggcgcatatgaaaaacctccggctatgccggaggatatttatttgccagtgaatcagccagagaattatttctcgtggcgttcccgcaggcggccaatgacggtactgaaatccaaatcttgatcctgcaataacaccagcaggtgatacatcaaatcagaggcttcattcgttagctcttcacggtcattcactgtggcggccagtgcggtttcaaccccttcttcacccaccttttgcgcgatacgtttggtgccgctggcatacagttttgccgtgtaagaactggctggatcagcagacttacgcgatgccaacaattgctccagttgatacaggaaactccagtcactggccgcaggcgcgaagcaactgctattgcccaagtggcaggttgggccgataggcttcaccagaatcagcaacgtatcgttgtcacaatcagggtaaatattcactacgttaaggaaatgaccagagctttcgcctttggtccacaaacgctgtttggtacgagagaagaaggtcactttgccggttttctcagtgaccgccagtgcttcctgattcatataccccatcatcagaacttcgccggatacggcatgctgaacgatggctggcatcaggtgatcgactttttcccaatccaattggttgatttgttgttctgttaacacactcttatctccacgccctgttcagacaaatactttttcaattcgccgatgttaatgatttgtttatggaataccgatgccgccagcgcgccatcaacatccgcgtcgcggaaggcttcaaggaagtgctccggtgtcccggcaccgccagaggcgattaacggaacgtggcaaatagcacgcatctgttgaagctgacgcaaatcatagccgttacggacgccgtcctgattcatcatatttaatacaatctcaccggctccccgtaactggacctctttgacccaatcttcggtttgccacgtggtggctttggtacgcttctcatcaccggtaaactggtaaacctgatagctgtcgctttcggtgtcataccaggtatcaattcccaccacgatgcattgtacgccatagcggtcagccaagcgggtaatgagtgttgggtctgccaatgcgggagagttgattgagattttatccgcaccgaatgtcaggatctggcttgcatcttcgacacttttgatccccccggccacacagaaagggatatcgatcacttctgcgacccgcgctacccagcttttatcgacgacacggccatcggatgaggcagtgatatcgtaaaacaccaactcatcagccccttcttgagcatagcgctgcgccaaaggcacgatatcgccgatgatctcatgattgcggaactgaacacctttaacgacctggccgtctttcacatccagacaaggaattatacgttttgccagcatgcgatagcctccttcacgttaaacttgccgtccagtaacgcacggccaacaatcacgccctgtacaccgctgccgcgtaagcgggcgatatcatccagacagccgataccgccagatgcctgaaacgcgacttgtggatagcgctggcacacttcctgatacagttcaacattcgagccgctcagcgtgccatcacgcgaaatatcggtacagaggacgtgcttcaggccgtaaggcaggtattgctcgacgatttgctctaacgttgcatcggaattttcctgccagccactgatggcgacgtgtttgcagccagcctcattaatgcgaacgtccaatgccagcacgatggcctcggcaccgtaacgctcaaaccactgctgcaccatttcgggttgcttaacggcggttgaacccaccaccacccgtgcagcccctgcttccagtaaagccacgacatcttgttcattacggataccgccgccgacttgcaccggcacatcaacaccggccagtaactcgcgcagtagtgggatctggcgagcggccggatctttggctccggtcaggtccaccaagtgtaaaacctgagcaccttgctgctgataatcttgtaaacgcggcagcgggtgattgccgtaatcacgttgctggccgtaatcgccctgatgcaaacgcaccaccttgccttcgatcaaatccaaagcgggaataatcatggtgcttacatctccagaaagtttttcatcaattgggccccagccgctccggaacgttccggatgaaactgcacgccaaagaagttgtctttttctactgcggcggtaaatggctcgccgtagttggtttgggcgatggtatttgggcatattggcattgcatatccatgcacgaagtagaaataggttccgtcagggataccacggaacagatggttaccggcttgtgcggtaatctgattccaccccatatgcggcagcggcaaaccaaaatcagtcatcttttttactggtgcatcaatcatcccgagggtggtgatcccgccactttcctcactgctggttgccagcaactgcataccaaggcagatccccagcacgggttgagtacaacttttgatcagttcgataagctcgcgttgcctcaattgttccatggcggcatgggcggtgcccacacccggcataaacagtttgtctgctcgcaagacgactgccgggtcgcggctgataaccggtgtataacccaaacgctgtaccgcataggtgacagaggagagattggcacaaccggtatccaggatcaccacatccattacagcactccttttgaacttggcagggtattgccttcaacgcgaatggcttgacgcaaggtacgaccaaatactttaaacaggctttctactcggtgatgatcgttgcgacctttggttttcaggtgcaaggtacaggccatggcatacgaaagggagcggaagaagtgctcgaccatctcggtgcttagatcgccgacacgctggtagttaaattcagctttgtattccaaatgcgggcgaccagaaatatccaaggcacagcgtgccaggcactcatccatcggcaatacaaaaccaaagcggccaataccccgtttgtcacccagtgcgatgttgatcgcttcgcccagtgccagcgcggtatcttccactgtgtggtgatcatcgatatacagatcgccgctgacctgaatatccatgcgaaaaccgccgtgggtggcgatttgatccagcatatggtcgaagaagcccacgccggttttaattttgcttcccccttcgcgatccagccaaacattaacgtcaatggcggtttctttggtcacgcgattaacataggcgtggcggtcgcgctgggtcagttgtttggcaatttgcgtccagttcaagccatcacgctgataacgtaatccgctgatacccatgttctcggccagttgtaggtcagtttcacggtcaccgatgacatagctagtggcactgttcatcacgccgtctgccagatagctttctaccagcgcggttttcggtttgcgacaggtgcagttatcctctggcagatgtgggcaaatcagtatctgttcaaaattgatcccctgagacgtcaggatttgcatcatcaggttatgtggcggatcgaaggtttcctgcgggaaactgctggtgccgaggccatcctgattagtgatcatcaccagtttgtagtctgctttttgcaacgccagcaatgcgggaatgacatcaggctccagcgccagtttatccaaccggtcaacctgataatcagttggtggctcggcaatgatggtgccgtcgcggtcaataaaaagaaatttctggctcatatcgttcccttacggatgctggaggtctgagaatgggttttactctggttatcaatgttattcgagttatcaatgccgggcaggggggcaagggcggcaatcactcgctcacactcctgacgggtgccaatggtgatgcgcaggcagttggctaaccccggttgtttattttgatcacgcaaaataatgccctgatcccacaatgcgttgaatacgctgctggacgcggtaaagcgggccagcaaatagttgctttcgctggtgaacacctgttcgacacaggcgcaatcttgcagtgcggattgtagccatgcgcggttagctcgtacttcactgacccgttggcgcatttgctcaatcccctttgggctgagtgcttgcgcggcaatatccgccactggcgtagataacggatagggggcgatcactttaagcagcaattggatgatatcgctgttggctaacgtaaagccacaacgtaaacccgctaatgcaaaggctttcgataaggtgcgcaaaatcactaaattcggataatcttttagccaattactgaccgatgcttgtggacaaaactcaatataggcttcgtcgatggcgacaatcgcgcggccttgcgccagtgccagcaccgcctgtaaatcagccgggttgattaaattacccgtcgggttatttgggctgcaaacatagatcacttttacctgatccagattgttggcaatggccggtaaatctaactgccagtcagcctgagcgggtacggtgcgccgttctacaccaaaggtttcagcgctgacagcgtacataccgtaggttggtgggcagaataaaatggcatcctgacccggctcacagaacgcgcggatcagcagttcgatcccttcatcagcaccacgactaaccagtacttgctctggcggtaaaccggcgtaagcggcatagcgctcaataacgtgcttaggctgacactcgggatagcgattgaaggtttgcgtggtcaactgatattcagtgcccagcggatattcgttggcattcagccagacatcgccattaccgcctaaccgacgtgcggacatatagggagtcagagcacggatgttggcacgggccaggtccgtgacgttattagattggctcatgcttactccttattcacggcggtcagggcgttattcaaggcggtaacgcgcagggtaactgcatttttgtgtgcggtcagttgttcggcctgtgccagtgtttcgatggtggaggccagccctaacaaaccctgtggtgtcaattgctgtacggtcatacgcttaacaaagtcagccaaacctaaactggaataggttgaggtataaccgtaggttggcagtacgtggttggtgcccgaggcgtaatccccagccgattccggtgaccaatcgcccataaacacggagccagcgttatcaatctggtcaatgatttcttctggttgacgaatttgtagaatcaaatgctcagggccgtatgcattactgatatcaatgcattgctgtaaatcgttggtcacgatcaaacggctgctttccagtgcctgacgggcaatatcggctcgggataacagcgcgagttgttgctcaacttcgactgccaccgcttgtgcgatagcggcatcaggtgtcagtaagatcacttgagaatcaggcccgtgttccgcttgtgagagtaaatccgccgcgataaacgcaggtgtagcaccgctgtcggcgatcaccaacacctctgatgggcctgcgggcatatcgatggcagcaccgtccaggcgctggctaacctgacgttttgcttcagtgacataagcgttgcccggcccaaaaattttgtgcactttaggtactgattcactgccgaatgccatggcggcgatcgcttgtgccccgccgatctggaatacttcctgaataccgcacagttgagcggcatacaaaatttcatcggcaataggcggtggagaacataaaacgacccgctgacaaccggcaatacgtgctggggtgccgagcatcagtacggttgatggcaacggtgcagaaccaccgggaatatacaagccgacggaagcaatcggacgcgtgatttgctgacaacgcacacccggctgagtttcaacatccaccaccggcattttctgcgcattgtggaagatttcaatattacgtaccgcctgtgccatggcgtgcttgacatcgtcactcaggcgcgccgaggccgcagcgatctctgatgcagtgatacggatatccgcgacctgcacatggtcaaaacgctggctaaaatcacgcagggcgctatcgccttccgctttcacccggtccaggatgtcactgaccgtcgcagtgatcctctcggatgcattgatggccgggcggctcaacagcgctttttgctgttcttcgctgcattgttgccaattgatcagggtattgaaattcgtcggctgcatgggttactccatcattttttcaatcggtaataccagaatggagctggcacccagcgccttcaatttctccatggtttcccagaacaacgtttcgctgctgaccatgtgcatggcaacacggctcttgtcaccggccagtggcagaatggttgggcgttcagcccctggtaacagagtaatgatttcgtccagacgttcgctcggcgcgtgcatcatgatgtacttggattcacgcgcttggatcaccccttgaatacgggtcatcaggcgatcaatcagttgctgtttatcaacggacatttcaccatcacgttggatcaggcaggcttttgagcggtagatcacttcaacttcacgcagaccattggcttccagcgtggcaccggtggataccaaatcacagatggcatcggccaaaccagcacgcggggctacttcaacagaaccattcaataaacaggatttaaaacgaacgccttgtttatcgagatactgttttaaaatatgcggataagaggtggcgatacgcgtatcttgcaggcattgcggcccagtgtattcagcatccagtggggcggccagtgaaaggcggcagccaccaaaatccaggcgacgtagggtgaaatagcgagggtcgtcgccttgagcgcggcgattaagtaactcttcttccagcacgttctcgccgataatacccagatcgaccacaccatccatcaccaaaccggggatatcgtcatcacggacccgcagaatatcgatgggcatgttctctgcgaaggctatcaggcgctgctgttgcaggttgattttaatcccgcagcgggacaacaactcttgggattcatcactcaggcgacccgatttctgcatcgcgatacgtaaacgtgttttatccagcatggtaatcctcttaatttattaatttatccccttcgtccttgacgtcgcagggttgttagctacattcactcgcccaacttactgactcattgactcacttgagccagctcattgggtgtcgttcgcttaccgcctgcctgcaatgccaattacgttgggtctataaaatgatgagcaataaaaaagccctcggaagattatcttccgagggctctctactgcgttctctacgccacctggaagattcgttaaccgtcttccagcacacatcggcctgtaagactagtcaggatgatggtggtgatggtgattaaattgaacgcgattcatagtggcttctctgtttgggctgttttgaataaatcaaagaattaatcaaaatagccatattcggaacgtgtcataatttctgtcaattaacgtaaaccatcaggctggtacagcgcaacctttttctggccagatgcttttatttcacagtggctaaaatgaatttatttgccataaattgtttcttttatggtgattatcactgaattttaattttcagtaagcagattgtttctttgatgtgccattgtgccgatgaaagaaaagaaagacctaataattgttaggtgacaccaactggcgtaagttatcggtatagcatgtgttagcagtatgagaagctaatactcagagccgcgagaggaaatcattgagatgaaaaaagtagccattattgggctgggttggttgggtatgccgttggcacaatcactgagccgtcgtgggatcgacgtggtggggagcaaaaccacccctgatggcgtcgatgctgctcgcatgagcggaattaattgctatccattggtactgacaccggaattaatttgtgagccagacgatttggcacaactgatggcggtagatgcattggttatcactttacccgccagccgcaccaccgctggcggggatcactattttcaagcggtacaacaggtggttgatagcgcactggcttttggtgtcccacggattattttcaccagttctacctcggtatatggtgaaacccgtggtcgtataaaagaaagttcaccgctacagccagttacggtcgcgggtaagacattaatggcgctggagcagtggttgcatcaattaccccatacctctgttgatattctgcgtcttgcggggctggtgggtacagatcgtcatccagggcgtttccttgccggtaagaccggagtgaaagggggctcgcaaggggtgaatctggtacatcaggaagatgtgatcgccgctatcgaattattgctgaatcggccaaaaggcgggcatctttataatttgtgcgcacccattcatcctagaaagcgtgatttttacccagcgtgtgcgcgggcgttacagttgaccccgcctgaatttgccgttgaggagcaagagggcgctaaccgcgagattgatggcagcaaaatttgcagtgaattggggtttgagtatttgtatccggatccttcgcggatgccgttgaattaagttatttcttgagtggtggtcgcgagttggtttttatttttaagggattgttatttccaaggggtttatgcttcaagggattgcctatttgcaatcccttttaaaataataattaccattcaataatcatcaggtatgattttacttattaaataaactactgcgatagataaacttatataaatgaatctttcatgccaggtttcgaaatggaaaaaccaataaaaacacaaaaaaaccaagaggctaccgactaatgccccgaagtagtggatgcaaccacgtataaatcgttttcgaaagttatcacgcggctctttttgttttgagttcattttccaccatatcaataattttattaaatgcggcatcaccatgatttctacgaacctgtaatgcttccacaaagggttccaacgcaggttctatcaagaaatataatagatcataattacgtgggtaaagtgcgtaataaatttcagggttttttctttgtagagaacgagatgtatagacactccgttcagccatccctccaataagcaggatattacctgctgcaccaccttgtaacgtaactaaaaatgcagtgcgttgagcaataattgaggccattttcccaaatatatagctgttggctgctgttctacctgctaatgagaacattgaacggctatatatgctttcttgcttctctttgggaacatatttattgaatatacctaagactgtttctatcgtttttacaaagttatgattttgcagaataccgtagcgaatagcttttgccattcttatatgttcagtttcacgtaaataacgagaatcagtatcaagataaccgtaaacaagataaccgagatctttaggtacagatagcactccgtgcatcagacctatcgccgaatcaggtgacaagatgatttttgctatacgccttgctatgtttatgtagttactcattttaatatcctttcctagtctaacggcattctaagccgttgtaactctatcctgattaattaaaaatccaattggtgtttatacagtcattgcggtttttcttaaacaagaaaaatctaattttattataaccaatactattggctttgtattttaccatcattcgatgatggtaaaacgggatgagatttatttaaccgcaaatggctttatgggtagtgactcgggatttgtttactgacaatcagatgccgtggagtgtttaccctatggtgcccaggtttttatacagattatctcactgagtatgcacccaaaataattcgagcttcaggaaggcggcaactgagagaatccccaggagcttacacaggtaagtgactggggtgaacgaggacagccaacgcatatgcacgttaaatatgacgggtatacttatctttaatagcactgagctcactactttgagataaatcgatacacttcataacggtgagttttgattcgccatttttgctgatatatttcttttctaggaattttttggcaagttcgctaacttcttcatacgcttctacaggataagcgcctaactccacataagcaccgaccgcagaaaaggcctcgctatttatttctccatcaggaaaaccctctgctaaacaaatgcttaatgcaaaattttctaaattgtttttttgttgcactttattctgattaacttctgctgcaagagtagagaaagaaattaaaaagataagtgaggttattgacaaagtgcccgcgacggagagaacaggcagatcgtaaagacgccgtaaatacatccatgtaggctcgagccgcgccatccttggcgcggacgctttactcctctgcctatcctcaccgttcaagatcgcgtcatcggggtttgtcagcagtctgataagtgatattattttagcagccataattgggcaccacctgcctgttgaaaataacaggaatcggaacatgaaattccgttccatagcgttgcatggcctgttgcagcatacaacttccgcatcactgactggagccagctcatcgggatttgtgcgctgcaccttattttgatttccgatcaccgtttctgaatataagtcagtgccagggccatagctaataccaagcctttaataatatccatcgcataataaggcactgacaacatcaccaacccattttgcaagacacccaaaattattgcgccaattaaggtgccgaacgcattaggtttacccgagccagccagtgaaaagccgatataggcggcggcgacggcgtccatcaaataaccactgccagcattcacctgcgatgaaccaatgcgtgaagccagcaagatcccaccgagtgccgccaattgagcggagagcacataagccagtacccgatagcgaaccgtgcggatccccgccagccgcgcggcttgtgggttaccgccaatggcgtacatccgccgcccgtgcttggtcagcgataaatacaactgcaccaccacggtgaccgctaacataatcagcacgataaccggtacctggccgagtgcggaaaaaatttctggaataaccccttccgccatatcgccactgggcaacaacatactttgagtgatcgaaccgccgcggctgtaagtcatggcgaccccctgaatcacaaacaggctggccagggtggctagcatatcggggattttcagcaccacaatcaggaaagcattaaacagaccgaccagtgtgcaaatcagcagcgtcaggattattgcgcccgtggtaccgaagccataccagacaaacagtgataccacgacggcattcgccaacgaggccgtggagcctactgacaggtcaaaaccgccaatcgacagcgagatagacaccccgatggcaattacggtcacaatggcgatagaacgtaaaatgttgatgatattgtttggatcgaggaagttatccgatgccaaaccaaatagcgcgattaacgcaacaacggtgagcaacattccccatttgtagagaaaatcaaacaactggtgacgccaagactgcacgtctggtaggggtaattctttgctcactgaggggttcctccggttgaaaatagtaataatgtctcttcatcgacctctgcagcattcagttcggcaacaattcggccatcccacaatacgcagatacgatcacataaaccgactaattctgaaaattcacctgatgcataaataatacctttcccttgttgcgccaattggtcaatcagagagaaaaggtcttgtttggctttgatatcgacccctttggtcggttcgtcaaaaatcagcacctgtgcatcaccgcgcagccatttaccaatggccactttttgctgattccccccagagaggcgggccagtttttgttgtggggatgatgtccgtatacccaggcgctcaatcagttccttagcccaactcaattcctgacggcggctgaagagactccaacgggaaaaactgtcatcggcggcaacactcaggttcattgggatgccttcgtcaataaaaataccttctttgcggcgctcttcaggtaccagtgccagcccttgcgccacggatcgatcgggtgagcgtggccgccaggctttgccgctcaattcaccgcgctccagcgtactaggcgtgtcgccaaacaaggctttgcacaattctgttttaccggcaccggctaagcccgcaatgcctaaaatttcgccctgatgtaatgtgagggagatatcgcgcaacttatactgatcatgtaggccgctgaccgataacagtgttttcggcaatagtgttttcgacaaccgtgttttcgacaatagtgttttgctgctgactgccgctcgccgaggggggaaaatatcctccagtgtatggccgagcattttttctacaatctgctcaccactcattccttccatggtgtcatggctcacgcgacggccatcacgcagtaccgtgagttgatcacacacctcgcgcagttcatgaatacggtgcgaaataaagacaatgccgatgccctcagattgcaagcgacgcacgacgcggaacaagcgggcgctctcttcttgatccaggggtgcagtgggttcatccagtatgagaaaacgacattggtgggacagggcgcgggccaacagcacttgctgcttctctgccagcgtgcaggattccaaacgttgacgcacattcaacttgagttccagttgctcaagcaaggcttctgcctgacgataaagttgtggccaattgaacaggtgcccccggtctgccaactcatccagcataatattctctgccacagacaacgtggggatcaacgcgacatccacctcttgttgaaccacatgaataccgtgctgcctggcttgccgtggggagtgaatatcgattggctgaccatcaataaagatctcgccacgatagtgattatgagcgccggagaggattgccatcagggtggatttgcccgcaccattagcaccgattagcgcatgggttgaaccaccttctagagtaaaatcaacttcttgcaaggcatgaaacccagagaaagagatagaaatattccgcatctcaaggcgggaggggggaatgctggacataaatttctgcgactgccctataaagtattttggtggccgataccattttgattgcgcaggtataagctgacgaattttctcaggtgtagatatttgagcgacaggcagtcattaatgctgctggtagccttcttttttaacacaatttgtattattagcaacaaactaaaatagctaagttatagcgaaacgcgttggcgttgcagtcaggcagcccttaagatggggaaaaacggggtcacatcgcaagctgtgaagcacactgatttggaaggaataaagggcatgagcgcgaacgcaattcgggtgcaggtggggcctgccaactatttttcttttccgggcgctatcgacaaactgagcgagttttatcctcaggcggcactggataaggctttgtggatttatggtgagcgtgcattggccgccgcccaggattatctgcccaaggcgtttcacgggccacaggccgtgcgtgccaaattctcaacacattgtagtcagtctacggttgctgatttggtcagcgcggcgggcggtgatcggcaggtcgtaattggtatcgggggcggtgcagtcctggataccgccaaagttgtggcccgtcagttgggggtaccgctggtggctatcccgactatcgctgccacctgtgccgcctggaccccgctttcggtctggtataacgaggccgggcaagcgttgaattttgaaattttcaacgatgccaaccatttggtactggtcgagccacgcatcatgttacacgcgccagtggaatatctgctggcggggatcggcgacacactggcgaaatggtatgaggccgtggtccttagcccgcagccagaaaccctatcgctgaccgtccgcttaggcttacaggccgctctggagattcgcaatgtgttgctcaagcagagcgaagcggcattgcaggcggttgctcagggtgaattgacacaagatttccttgatgtggttgatgccattattgccggcggagggatggtcggcgggttaggggagcgctatacccgagttgctgctgcgcatgcggtacacaatggcctgacgttgctgccacaaacggagcacttcttgcatggcaccaaagtggcatacggcatcttggtacaaacggcattgctgggacaagatgaggtgctgcggtcactgattgttgcttttaatcaattaggtttgccaacccatttggcggcgttagatgttgatattaatgaccgggaggcaatagaccgggttattggccggatcctgaaacccggagagtcaatacattacctgccaatcgccctgaattcagaaaaagtatgggcagcgattgagcaagtggaaatcgcggctcagcactgatacggcgcgggagtcggtatttgagttaaggctgaaaaagaatagggtttaaggtgatttaacatcttgttttttgctctcaagttagggcaaaatacgccgaatgaaatagccgacgtttaaacgcgtcggttatttttttttgcattcgtattttcagacaaccaagaggccggacaacgatccggatagataaacaggttcgcgcgcgattattcacaaactgaaatcgccgttatgaggaaagaagaaagatggggcaattattcattttggcaccggtgcccaccggtatgcgctgcacatgcagcgattatggcgcagcaggtatggcaaatacccgttacaccgctcttatttccccacttacgtatcccaggcagatacgaagtttccccgtcacttttaaccgctgcgagacatttgcgaatcgggttgaaggtatggggaggctgaatcatggcgcatgatgcaactgttgccgtcggcacgaatcaaacgggtaccaataaccgcgtccaactcagaaaaaccctgacgttggttcaagtggtaatgatgggtctggcttatctacagcctatgaccatttttgatactttcggtattgtatccggcctgaccgatggtcatgtcgcgacctcttacgccattgcgttgattgcggtgctgttcacggccgtcagctatggcaaattggttaagcgcttcccgtctgcgggctccgcttatacctacgcccagaaatccatcagcccgaatgttggctttatggtgggttggtcatcattgctggactacctgttcatgccgatgatcaacattctgttggcaaaaatttatcttgaggcgattttccctggtgtgccgtcgtggatttttgtcggtgcgctggtcagcctaatgacgctgttcaacctgcgtggcatcaatatcgtcgcgaacctgaactcggtcattgtggtggtacaggtggcgatcatggtggtctttatggggctgctgatccatggcgtttatcaaggcgaaggggctggtacgttagtcagtgcgcggccgttctattctgaaaatgcgcatttggtgccaatgataaccggggccacgatactctgcttctcgttccttggtttcgatgggatcagctccttgtcggaagagaccccgaatgccggtaaagtgatcccgaaagcgattttcctgacagcgttgattggtggcatcatctttatcgcggtgtcttactgcttgcagctctatttcccgaatatttcgcgcttcaccgatcctgaagcgtcacagccggaaatcatgctgtttgtggcgggtaaattcttccagtcagtgatcctgtgtttctcctgtgtcaccgtattggcatcaggtatggccgcacacgcaggggtttcacgtctgctgtatgtgatgggccgtgatggtgtattcccagagaaagtgttcggttatgtgcaccctaaatggcgtactccggcgattaacgttctgttagtgggtggcgtggcattgtccgctatctcatttgatctggtaacggcaacggcattgattaactttggtgcgctggtggcgttcaccttcgttaacttgtctgtgattgctcagttctatgttcgtgaacgccgcaacagtacgttcaaggatcacttcaactacctgattctgccaatgattggtgcgggtacggtgggggtactgtgggtgaatctggaaagtagttcaatgacgttgggcctggtctggggcgcaattgggttgagctatatggtctggaaaacgcgcgctttccgtcgggcgctgccgcagtttactgaagaacctgcccagttataaggcaagctcacgctcatcattaagtttatcaatccggcacagtctctgttgccggattttttgtattcagaaaaccaggtcagagcgtattgccgtgcggctacaatctcaatcgtgattaggctagaaaaatgaatcgaggtgatgaactccagcaggcagaccctcaactcgtcgtgggaaaataccggatagcggataatgccgcccctaattcgcaatagacgataccgagtaaccgtacccattagccatagtattacttttttagttatttaatttggcaggccagaaacatgggccacgccaccaccaccctcctcagaagagtaatcattagggttacgtcccccccgattcttgtgaccctctttttttcactatgactaacgtattgatttttatgctactcaggtatttcactaaaaaaaaggtttttacgcattttgcgccattgctcattgataaacatcgggttatccgtattatcttactgttcactgccgcacaggcagcttagaaaaagtaaggcacagaaggttgtcacaatgacaagttcactgccgcacaggcagcttagaaaacaatattttttccactaattatcatattagagttcactgccgcacaggcagcttagaaactgggcctcgctgctaaaatgatcgtgctcttgttcactgccgcacaggcagcttagaaatcaggctggcggcgaaatcaccacctttgcatgttcactgccgcacaggcagcccaataatctcagctctctggcggcgctttatctgcaaatattaactcactaatcccttggcatattcaaacaacgcttttagcagcgcaagtttctctttatcgtcttcatactggttataaaattgttccagttgcaaaacataatcttgtacccgctcagggctaagcgcttcacggcgatgctgtaaccaacgctgttgttcactgttattcaaggtatttgggtagttacgggcgcggaagcggaatagcagggcctccaaccgtgggtcctgaaatgtcaaatccagtgctggcagattttgtggctcagtttgctggataatcttcatggtggcgcggtcagcatcactgaaaaagccgttatacaactgtgtatccacatcatcggtaaccgcgaatggctcagcttgtgcaaacagcgcgaccactttttcacgcacctgcgggttttgccgcagcagttgcagattttgcaaacaacgctggcgatcaatccccaagcgatcagcattctcgggcagcagagtttttgcaggagccaataccggacatttattgatatgtaccagtttgatagggattgccgactcttgggcttggagcttgtcacggcgggtatacagacgttcgcgcaatgtatcgctgtccaactccagtaatggggacatatccccggccagatcgcacataattaccgcatttttattctcggggtgccaggccagcggtgccacccaactggtgttgccccgtgcggcaccaaacatgccagacacatgaaccagtggtgtcatctccgcgatatcaatcaacgcattgatcttatgcttactgcggtgctgatacagataatcaaacagacggggttgggcctgtttcaccaattttgccattgcaatggtggcgtagacatcggacatcgcatcatgtgcctgtaaatgttcgacgccattggctttggtcaaatgttccagtttaaagctgggcaggccatcatcattttcgggccaaacaataccttctgggcgcagggcatagcaggcgcgcatcacatccaacagatcccaacgggaatttcccccctgccaactgtaggcatagggatcataaaaattacgatagaaaatgttgcgactgacttcatcatcaaaacgaatattgttgtagccgaggatacaggtgccgggtaccgaaaaggcctggtgtatttggcgggaaaactcagcttcattgaccccgttggctaaagcatgttggggggtaataccggttatcatcaccgcttcgggctgtggcagataatcatctgcgggcttgcagtaaatgaccaatggctcttcgacgagattgaaatccagatcggtacgtaccccggcaaattgcgcaggtctatccaaggctggccgctggccgaaggtttcataatcgtggacgtaaaatgttggttgcttatttttatctgacattattcggtttaacccttcatttatcgtggtcatattcgggtgggatctgcttgcagaaggcaacccgcagcgacggatgacgttgacgctagaatatcatttcaaacgagtcgagacgttaattttgtctcattaatgatggcaatcactggatacctgacgtgcttcaggccggattattgttaaataattctatttcaactaaaacctatcgatctggctaatatttacctgccgtttactcagtgatccatacaatccgttgactaaaaataagacaggatcagagacgttgaaaaagcttttattaaccggcgcaacaggttttcttggcggggcagtactcgaaaagttattgttggcaagttcagattttaattatttattactggtgcgagccaatacaccagaacaaggtttaatgcggatacgcgaaaatctggagaaattttatctgccaaatgagctgattaataaaataaatattaaccacgtattattgggtgacttggctgagccggatagttttattaatgatgtgcgtattgatgacgtcactcatgttattaactgtgcggctatcgcttcattcggtaataatccgttgatttggaaagtgaatgttgagggtaccttagccttcggcaagagaatggcacaggtcgctggtttacaacgttttgttcatgttggaacggcgatggcctgtacgccagaggccgatactgtggttgatgaacgggtattgtccactgagaatgatgctcatttagtggaatacactaaatccaaatcagctattgaatgcctattggccgaacactgcccaacattaccactggtctttgcccggccctccattgttgttgggcatactcgcttgggatgccagccttccagcagtattttttgggtatttcgcatggcattaatgctgcggaaattcatgtgttcattagatgaccatattgatgttattcccgttgattattgtgctgatgcgctgctttatatcttggaatacccaaatttaccggataatatttatcatatttctgctggagaaaaaggcagcgtcagtttctcggaaattgatcaggcgatgtcagtagctgccaaacaaaaacccgtgggtgttaattatagccaagtagaatatacggcgttggtgcagatgcgtaatcaactgaaaggtatttttggcccttgcaatgaacggttaatgttgaaagcgatgcggctatatggctcttttgccatgttaaatgtgcgttttagtaatgagcgcttgttgagtttggggatgccgcgcacgccgcgctttaccgattatattgcccgctgtgtggaatctagccacgggatgactatccagcaacaaatggctgtcgattttaaataattcaaggcgctgcgggtcacgttgggcctgattgcgttttatcttgcatcgtatcctgatcttaaaccgttctctttcactccgatgctaacggtgatacaaaaacaacaggtaaaaatgcccgtttacggctatgtttggttgagtatagcgttgactcacccctaaataattcgggttactgaacctagccaacgcacatgcagcttagagtatgatgggtataaactgcttgaggaatgagatgatcgcattaatatgaccctgcgcaagtgatgcatcatagccatcaggcagatgaagtttctgtctgatgggtaaagcaggtaagataagctaatgaatcttgtcaccaggcacggctaagcggtatggtttgggtagcgtggtcggcagccgttgaatttgtgtaaacttaagtgaaggtatgaaaatggataatgcaagtaagccaactttccaggacgttttggagtttgtgcgtatgttccgtcgcaaaaacaaattacaacgtgaaatcgttgataatgaaaagaaaatccgtgataaccaaaaacgcgttctgttgctcgataacctgagtgaatacatcaaaccaggcatgagcattgaagaggttcaggccattattgctaacatgcgtggtgactacgaagatcgtgttgatgattacattatcaaaaatgccgatctgtctaaagagcgtcgtgagttgtcgaaaaaactgaaagcgatgggtgaagttaagtaaggtttatccaacgtaggataacccccttttagcggttttgaaggggaaagagagtggggctggcatctattgtcagccctttttattggtgtgccagagccctcctaaccccgttcagggttaggaggggggaacaaactattttattttatacacatgtaagcaagagtgacattcgaagccgaatgagtaagaccagtatcgatatggaaatcattagtatctactgacgtccaaatgatctgggcggttgggaaacttggataggcattcaagttaccccactcaccgaataacgaacctacaccacgaacatcttgacccgccgatacttcgctattggtcggtaatctcattccggcgttgatacatgacgcattggcctgcgcccagctcagattagtcgagctatagaggcctacccaataatttagcgtaaagtcataagtgaacactttgctgctgtcatgtttccaggttgccgtaatggtcactttccctccaggattatcctgaagcgtaattgcacctgtgttactgacactcacgttaggatgactacttacccaatcatagtcactgttagcgccggtaataccatgtggcgataattggaagtgagtatttttaaatcctgttgttgggaaaccactgttgatattaaagccactataagtattcgctggcgtattcaacgtggctttagtgaaatctggatagaagatgacgggtttatcttgtgtactggtcacgttcgctgaattgatcatcgttgccgtcaccgtactgatagtcccaccaacattggtcatagagaggttagtcgttactttaccattctcatctgttttggctgaggttgtctctgcgaccacgccgttagtggcggtaaaattcacggtcatattagcaacaggatttccctttttatccacaacaagggcctgtacttggttagttccgctcccagcgacttgaccatcgacttctaccgtaaagttattagccgtaatttctgccgtggcagtatcggcaataaagttaacctctacggtttgttccttgcggttgagcgttgctttcactgtatggcttttagcctgactactgatgatttttgctgttgcgacaccattagcatccgttggggtgacttcactaattatcgccccgatatccgtggtaaaggcgacatccacaccaggtacggtgttaccaaacttatcgactaccgtcagttgaacgctattggtgctttcaccatcggctacctgaccattagtgacccactgcaatttatactcatcactgtcatccagtgttgcagtgccagcatctgggataaagttaacatcgatctgttgtgttaccccattaagttcggctgtgaccgtatatgtacccgctttggtactggtgattgctgcggttactcccccttgtttgtcgctcaaggtggtttctgttattttggcattattgcccacagtgaaattgacttgaacaccagacaatttattgccataagcatcaaccaccacggcgcgtatttggttagcatcagtatcatctgccaggctaccattggtgatgatttgcaggctgctcgtttgtaacgttgccgtgctttcatcggcaatcaacgtcaccttggtttgcacatcggctaatggcacaccattaatctgggcggtaatattaatcagttgtggcttacttcccgatgtgagtgttgcctgataaatacctggagcagattcagtaatcttcgttagagtatgagacaccgtcttcaatggcactgaacgtgctttagccttagccaattcttcaggtaactctaccagttcgagagaaaatgccagttcatcggcaatccccgtgatgggctggttagcattatctttaatattgaattcaataacactgcttgcactcgcatttgccggcagaatttctggcgcagcagtcaagcctgaggcgttagtattcacaccatggctatctaccacgagatcgctgtaagcaacgggagaagcattaccaagggtgtcgtatgcgatagcactaatacgataagtgttattaccctcaccaccagacagatagcttggcaatgttatctgccaattattgccgctaccggttatctttccacccgctagcgttaaggcactggcttcccattcaatacgatcaataccttgttgtgctgtggcatttgccactaatggcattgtttgtcttgccgcaccactaacacgtgctggcagctctagggtaacccgattctgcttacggtatttcatcacaatctgattattacggtcgaccagattatagcggctacccattaagctacgtttaattgcgacggcatccgaatcgagctgatgtgccagaggagtgccaaatgcatagttaaaaccaaggttgaaccgggtgtcattcattcctgcgcgccccattttatggtcgacaccaacagtaaataaaggaattggggtataattcacacccagagtgaccgcaagagggtttttctgacggttatccacaccaaacaagccaacttcatcaccaaaatattgttcatatatcagtttcccccccaattgtggcaacgttggcagataagcttcactgcgtaaatcaaaaccgtttgcgactttttcatcatacttatcaagatctggcgaatttttccaaccactgacaccaacgtagccgttagctgccagattaataaaatcacgaccatattcagcaccgacgccaatacgggtatggctatagctggcatcatgatcaacaaacaggttgtagcccagcatttgctgtgcaaagaaatgacgctgacccaaaccaacgttcaatgtcactcggtcatcaatatagcggccacccaactgagtaaaggtgagtagatctgggctatcggtcagcggcagcaatacatccagttggctgcctttaaggctcaatttctcatctagatttagttgtactttcgcactgccaaactgattaaaccacttttgcaatgcttcattacctgcattggcagcggtgccgcgcgcaatggaactcgcttgtttggtagagtcatcatttgtcaatattgatgccaaccgtgttgctgcattggcggtagactgttcagcctgtgaggccgaacgcggtttttcatccgaggctccgacggtttcagccgccattaccgctggggtaaaagcaatactcaaaggaaatatggcttggattacaatatttgcccagacgactgattttgaaattcgggttttatttaactgcttgtttttatttaactgcttggcttgatgtagtgatgatatgcgatagagactcatacttacctatactccacgaactaaggattaataataaaataactggatacgcttattggtattttttatttatgaattaaatggcattaacccagcatgtcaaatacgggaggttagccataaaatggtgaaattgttgttatgactgagggctgcgagtgagtatttattggcaagagataaaattagtcatatttaactaatatcggaattaatacctaatatttattagctaacatgaattattaaattgcttttaattaataaaacaatcacttactgaatttctgttacagcaattcattgcggcattcagttgttatggaataaattacaaaagatacattaataacaccatgagtcaattcaagtaacaaatttgatgcgccattaaacatcatgcaacatactttatatatcggaatacaagagaacttaacgtaggaatcttcctatatgaaattgtcgttaagattttttattactagaggtctattttaaattgcttactgtaaaaggacattaattttataaataaaaatgacattttaaaaagtcaatctgacattattctgaaaacaaatacacacattaataatgcgtgttctctattcattctggctaaatatacggtggtctatacccaagtgactgcaagataccggtaggcagcaagcgtgtaattaacgtagccaacgcacaggcaacgtgaagtacgacgggtataacctgcttagcgggaaagaggccaaagcggtggaaagtgcagaaccagtatcaaccccgtggctatcgttcatatggttatcattcatgtgaccatcgtagaatggctgattcagtgattttctgcacataaaatgaccaatcattgccaaatttgttgatgataagttaattttgcgttaacgatatgtaattgaagtcggtgcagccaaggtgattgacccagatttcattttttaatgcccttattagcctgacctttagtccctctcgtcgtcatccgttagttatgtcattaacacggaggtccaatatgtcgaactttaaccactatccagaccccacgcttaactctgctatcaagaaagcgtggtaccgcctaatgccactgatgtttatcatgtatttcgttgcttttattgaccggataaatgtcggttttgctaaagatgcgatgtctgccgatatcgggttgtcacaatcggcttttgccttaggggcgggtattttctttgctgcttatgctctcttcggtatcccggcaaatttaatgatgaataagttaggcgccaaggtatggttgagctcaacaacggtggtctgggggttgctgtccgccggtaccggtttggttagcaacgaataccaatttgttatcctacgctttctactgggtgtcgctgaagcgggtttctatcctggcatactcttactggcgtcgatttatttccctaacaagatccgggcctcggtcattggtatcttcgtccttggtgtccccgcggctcttacactggggtcgcccatttctggcgcattattggatatgcagggctttctaggccaaccggggtggttttggatgtttctgctggaggggttgcccgccgtggggttaggtatttttgcctttttctaccttgatgatagccccgccactgctcgttatcttaatccagaagagaaacaggctcttctcacccaactcagtattgaacaaagcgatactgagagtagcagtgtaaaagcggtattactcagccctaaagtttggcatctggcgttgatttacgggacgatccaagttggtgtgtatggtttgatatttttcttaccctcgcaggtcgccactttgcttggctctacgttgggattcaaagaatcactggtggccgcgataccttgggcattttctgcgttaggtgtgtattacattccgcgctatgccgatagaaaaacccatcgccgcaacccgattgcgacgctgaacctagttgtcgcggcgatagggctgatcatttcagcttacgccagccctgtattggctattgcggccctgtgtctttgcgccattggctttttagccgtacagcctattttttggacattccctgcacagattctttcagggaaagccttagcggcaggtatcggattttgcacgactatgggggcatttttcagttttctggcgccgataatcagagttgaagccgaaagccagttcaacagcccaccagccggtctgataacacttgcacttttctcgctgctgtctgccacgttaatcttttcgttaaagttttggcctgcaaaagcaacggctgaggttatctaaccagcgaattataagaatcgccgttcatgatccgcttttaacttcctgacggcatcatagcggccaaataaacggtagcggttaagggcaatgccgtcatagcatcgatcacgtaacggacgcgggaagatacgcaacacaccgagtattcgccatggccacggtaagtttgctattacgcggaagatagcctcggaacgcagataaacctgctgattttcaatcagtacgagggtgttaattttgtcagttggcaactccgcccattccagcaatgcgcggccttttttcgattgtacggcggacagacgcacggtgtggcggcggtcatggcgaataagaaaattaacccagccagtacacaacgcgcagacaccatcataaatgatgacgcgctcacctggcttgatatagggcagcggagcggacaccacctacctcctgagagcgtttaacgatgttcgaaaattgtagtcactgtattttattacggtcactgtattttattacggtcacaatattttattacggttaccgtcttcaaatgcgttttcatgttttttctggcagtaagggtatcacgcgctttgaacgtggtggatccgttatttatctataatttattgtatcttatgtttttttcacggttctcgtcatcaaaataccttctacgttaagcgattcagcgtgcatttataaggtgtaaatattgctgatttgttttttgtatgtaaataattggttaaataatgagcgcatttaacggctgcgctgatcaacatgttagccaaaggatcggtctgcaaacgttttacctttcgtggcctgaccattagaccttgaagccggggaataacgatgaatctgaaagggaagaaagccttggtcactgctgccgggcaggggatcggcttcaatacagccacgttgtttgcccgcaaaggcgcagaagtgatcgctagcgatatcaatatcgctgcgttgtccaacataccgggtataacggcagtgtcattggatgtgactgacacgttggctatcaatgatgtggcgcaggcaatcggcccgatagacgtgctgtttaactgtgcgggcgtggtacacagcggcgatattctcacctgtagcgagcaggagtggcagttcgcgctagacctcaacgtcaccgccatgttccatatgatccgtgcctttctacctgggatgatcgcgtgccagcagggttctatcatcaatatgtcttcggtggcttcaagtattaaaggggtaccgaatcgttttgcctatagcacttctaaagccgcggtcattggcctgacgcgttctgttgctgcggattatgtcacgcagggcatccgctgtaatgccatctgccccggaacagttgaatctccttctctgcgtcagcggattgccgtacaggcacacgccgaagggcgcagcgaagctgatgtctttcaggcattcgctgcacgtcaaccgattggccgtatcggcaaagcagaagagatagcgcaattggcactgtatctggcctcggatgccagcgcttataccaccggcacgatacatattatcgacggaggctggagcaattaatacttagcgaccgtcatgggtattcagtcagttctgaggagaacgacatgaaactattacgttatggtcccgtcggcgaggagcgcccggcgttacttgatgagttgggagagattcgtgatctctcggcacatatcgaggatatcagtggcaaatttttactgcctgcgacgctgtacaaactgcgtcagttggatagcgccagtttgcccctcgttcggggtgaacaacgccttggtgcttgcgtgggtcatgtcggtaagtttatctgtgttggtctgaactacgccgatcatgctgctgaaacgggggcagaaatcccgcaagaaccggtgatcttcaataagtggaccagcgccattattggtccgaatgacgatatagaaatcccgcgtaactcagtgaaaaccgattgggaagttgaactgggggtggtgattggcacaggcgggcgatatatcggtgaggccaacgccatgtctcacgttgctggctattgcgtggtcaacgatatttccgaacgtgagttccagctagagcatggcggtacctgggataaagggaagggttgcgataccttcgggccgattggaccgtggttagtgacccgcgatgaaatacccgatccacatcagctagggttgtggttagacgttgatggcaggcgctatcagaacggcagtacccgcaccatgattttcaaaatcccgcaaataatcagttatctaagccgctttatgagtttgcaatccggggatgtcatttctaccggtaccccacctggcgtgggtcttgggcaaaaaccgcccgtctatttacatgcagggcagataatgcgtttgggtatcgaaggtctgggagaacagtgccagaaaacgatacaagcgtagtactcatctttcgcgaacggagaggttaaccatgacaataatcactgcattacgcactgaggatgtacgttttcccacctcgttggaattggatggttcggatgcaatgaatcccgatccagactattcagcagcctatgtgattttagacaccgataatccggcactcagtggccacggtctgacgttcaccatcggacgtggtaatgaaatttgctgcgtggccatccatgcattggaacatctgatcgttggccgtgatttagcgtcaatgactgccaatatgggtaagttttggcgtgaatttaccagcgacagccagctacgttggatcggtccggagaaaggcgcgattcatctggccactggcgcggtaatcaatgccgtatgggatttatggagtaaggcggagggcaagccgctgtggcgtttagtggccgatatgtcccctgaagagttggtgcgctgtattgattttcgctacatcaccgactgtattaccccggaggaggcattaacgctgttgcagcagcgagcgcataacaaagccctacggctggaaaaattgcaagacgaaggctacccttgctataccacgtctgcgggctggttggggtatcccgatgataagttacggcgcttatgtcaggacgcggtggatgccggttttgactatttgaaactcaaagtggggcgtgatctcgaagacgatattcgccgggtgcgcattacccgtgaggtgcttggtcctgatcgtaaactgatgattgacgccaatcagatctgggaaactaacgaggctattccgtgggtgaatcagctcgcgtttgccaatccgtggtttattgaggaacccactaatccggatgatatcgaaggccatcgtcgtattcgtcaaggtgttgctccggtcaaagtggcaacgggcgaaatgtgccagaaccgcattatgttcaaacaattcatcatgcgcgaagccatcgacgtggtgcaaatagatgcctgccggttaggcggggtcaacgaagtgttggcggtaatgctgatggcggcaaaatacgatctgccagtgtgtccacatgccggtggtgtcgggttatgtgagtatgtgcaacacctggcgatgattgattatctgtgtattgccggaacggataaagggcgagtgatagagtatgtcgatcacttacatgagcattttgttcacccgtgtgtgattaaaaacgcggcctatatgccacccgagcaaccgggtttctccatcgaaatgcatcaatcgtcgatagagaagtaccgttttcgcgtttaacgtcagtggtagcgcaaatcaatagcgatagcacaaatcaataccacgagctgagcccatgagcagaacggaggaggaacgccatcgcatcatgataagtgtgattattatgattagcgagattgtcatgagaagtgaaattgttatgattagtgagattgataatcaagtcagaccagtcagtgactgggggtgaacgaaagccgccaacacaccagcagcttgaaatataacgggtatatttttatcaaccataacaccattatggaccgtgaagatgatcatttctgcctcaacggattatcgtgccgccgcgcagcgtaaattgccgccgtttcttttccactacatcgacggtggtgcgtacaacgaacaaactctacggcgcaataccgccgatttggctgatatcgccctgcgccagcgtgtgctgaagaacatgtctgaactgagtctggaaacgcagcttttcggcgagacgcaggcaatgcctgttgtccttgggccagtcggtctgagcggcatgtacgcacggcgtggtgaagtgcaggccgcgcgggcggcggataaaaaaggtattcctttcaccctctcaaccctttcggtttgccctatcgaagaggtggctcctgccattgcccggccaatgtggtttcagctttatgtcctgaaagatcggggttttatgcgtaatgcactgacgcgtgcacaggccgctggcgtgaagacgttggtgtttaccgtagatatgccggtacctggcgcacgttaccgcgatgcacactctggtatgagtgggccgaatgctgccgctcgccgcttgcttcaggcgatagcccacccacagtgggcttgggatgtgggcttaaacggcaagccccatgacttggggaatatatcggcctatctcggtaaaccaaccacgctggaggattatatgggttggatagcgacaaatttcgacccatcgatctcgtggaaagatttggagtgggtacgtgagttctggcaaggaccgatgatcattaaaggtattctcgatccggaagatgccaaagatgcagtgaaatttggtgctgatggcattgtggtgtcaaaccacggcgggcgtcagcttgacggtgtgctctccaccgctcgtgccttgccagccattgcagatgctgtcaaaggggatatcactattctggctgattccggcatccgtactgggttggacgtcgtacgaatgatagcgctcggcgcggatagcgtgttgttaggccgtgccttcgtctatgctctggccaccgcaggagaagccggtgttatcaatctgctgacgctgatcgagcaagaaatgcgtgtggcgatgacgttgaccggagcgaagcgaattgccgatatcaaccgggattctttggcagtaagtgaacgggggtaaaagaataataaataaaaagcgtttcagagcctgtatcgggtgatggctgtctgatgatttggctgaataccggcctgatttactgtgacacgagaagggttaagggggggaagctccccttaaccgcttggggtcgcgcaggtaatgtcactgccatctcatgttaaatgagcacccacgttcccccgctaatgccaagaataattactgacgcttatcctgcaacccacgccctgacgacagattattgttatccacttgtggcaaccccgtcgccgcagaagaggttaacagccccgtctcaacatagttgaataacttctcgcgggtatcggtgatgtccagattacgcatcgtcagttggccgatacgatcatctggtgagaacacggaatcacctttctccatggtcaaacgttctggtttgtaagtcagattgtcagacacggtattcaggatggagtaatcattgccacgacgcagctccagcgtcacttcaccggttatctcgctggcaacccaacgctgaatggagtcacgcagcatcagcgcttgtggatcaaaccaacggccttgatatagcagacgacccagtacccgcccattagcatgatattgctcaatggtatcttcattgtgaatacctgttagcaagcgctcataggcgatatgcaacagcgccatcccaggggcttcatagatgccacggcttttggcttcgatgatacggttttcaatctgatcactcatacccagaccgtgacggccaccgatgcggttagcctccatcatcagctcaacgctatcgtcaaagacaacaccatttagcgcgaccgggtaaccacgttcaaaacggacagtgacttcttcggccttcaccaccacattttcgtcccagaatttcacgcccataatcgggttaacgattttaacgctggagttgaggaactccagatccttggcctcgtgggtggcacccaacatattggagtcggtcgagtaggctttctcggttgacattttgtagtcgaaaccggattggatcataaattctgacatctcgtggcggccgcccaattcatcgatgaaatcagtatccagccacggtttgtaaatttttagctcagcgttggtcagcagaccgtaacgatagaagcgctcgatatcgttacctttataagtgctgccgtcaccccagatatttacatcatcttctttcatggctgccaccagcatggtgccggttaccgcacggcccagtggggtggtgttgaaataagtgacacccgccgtggtgttatggaatgcgccacattgaatagcggcgataccttctgccaccaactgcttacggcaatcgatcagacgggctttttccgcgccgtattccatcgctttacgcgggatggcctcgtaatcttcttcatcaggctgacccagattagcggtataagcgtaaggaatggcgccttttttttgcatccacagcagtgccgcactggtgtccaggccaccggaaaaagcaataccaacacgctgattaataggaaggtgtttaagaatagttgtcatcaattaaatcctgtatgaattaggtcagtctggaaaatgtttcaatgcctacagtgatatcgcaaaacccgccgtcgagtcaaagaaattttgcatatttatgggtttttattgcataagtattgcaatttcatttcatgaaaccatgttccatttaaaataatcctgtattctattgtgggacctgcgtgggttttttgaaacgcgcagcgggttaaaatatctagcgggaaatcaacattgtaaatcggcgcattgggatatttcaccatagtggtggaaagcgcggatggatgcaaatgaacagggtttcagaggccgttaagttgaaaatcttccgcgaaagcgtgtggtataagaagcgaaaatcatctcgggtactcttttggcgtgagatcacaccgctggcctttccgttgtttattgaaggtttgtgcgtactgctgatgggggtatttagtactctgctggtgagttggttgggtaaagaagcgatggcagcggtggggctagccgacagtttcaatatgctgattgcggctttttttgcctccgtggcattagggacctcggtcgttgtggccttcagtctgggccaacgcaaacgccagcaggcgcaaactgccgcccgacaatccatgacattgctggtattaatctccctgttattagttgtcttggttcatttttcaggccagaccattattgatttaatggctaaccaggcagacccctcggttaaagcaatggccctgacctatctgcatttcactgtctggaattaccctgcgatggcgataaccttggtggggtgcggtgcgttacgtggtgcgggcaatacgcgtttgccgatgcttattaacattggcatgaacattcttaacattgtcattagcagtatattaatttatggcctctttaattggcagggactgggttttatcggtgccggtattggcatcacattggcccgctctgcaggcgcactggtggtggtcgtgctgctgatttacggcgcgaataatacgttgcggatccccttcaaagcctatttcatgccttttacctcggccattatgtttgaggtgctgagcattggtattccggcgagtgttgagtcagttatgttcaatattggcaagttaatcactcaacggtttgttgccggcatggggaccgacgtcatcgcgggtaactttattgccttttcaattgtggcgataatcaatctgcccggtaatgcgctggggtacacctcaaccattattattggtacccggctgggcaaggggcaaattttgcaacctattcggcagataaaacatatcttttggctatcgacgcttggggtctgctttatcgcattgctgtccattcccagtgcgggttttctggcctcgctgtataccgatgatccggcagttatcacggtggtgaagcatttgatctggatgaatgcgttatttatgccgatttgggcggcgtcttgggtcttacctgccggcttgaaaggcgctaaggatgccagttacaccatgtgggttgccctggccgggatgtggggctgtcgcattattgctggctacattctgggggtaacgctagggtttggcgtgacgggggtatggatggggatgttcctggattggatggtccggggggtgttgttttatcgccgcatgtccacgggccgttggttatggcgctaccggcccagcgtctgagaatatgagcaagtgtcccccatcgaattacttcacactctgcggtgccacgtggtgggcaaacagcataatgacgccagagataaagcaggggatggcaccgaataacagggctgcggtctgccagttgcctccgctgctgagaatgctggtcgcccccatgctggcaataatggcaccgataggccccatggcgatgataaatgcaccagcagtggcacggatggcggtgggaaaactctcactaaagaagaatagggcggcagaatatggccctatcaggaaaaacagacctgcgctgtacaggataacgatgagggaaaaatcggctggcccatagagcatggtggctaacgataaaccaccgagcatccaacctagagcaatgatattccggcggccgaaacgatcccctaaccaaccatgcgccagataaccgcaatagcccaccaggttagaaagcaccagaacccagagtgaactctcaaaggagacatcgtgtaccttcgtgataaccgtggtgccgagcaccccgaaaatctgaatagcaaaccagttgatcattaaggctccgccgagtaccagtgtggtgcgcagtgatgtgccacgaaaaatggctgacaggccggtacgttgatgatcggcatactcaaaatgataatcttttgccacctgacgggccttttctggctggccagcttccgttaaccgacggatgtgctggtggatttgaaattgtggggtttcttttagttttagggccagcagggcaataataaacgaaggaactgcggcaaaaataaaactcccttgccagccgataatcggcatcaacagtgctgacagccctgaggcgaccagtgcgccaactggccaccccccttgtaccagactataaataaatcctttgtgccgatttaatattgggtcgttaatggcggcatacatttcggtgagatacgtcgcattcaccgtttgctcggcgaagcctagccccgctatcgaacggataccgaccagtacgcctttgccccatgctcccccgattgcggtcaacagagaggatatcgctgcaccggtgacagtaaacacaatgcccaaacgccgccccaacctgtcaacgatggggccgacagtcagcgccacaacagcacctccagcggcgacccaagtcgctaacttagcctgttctatttcatcccaaccaaaatgatcaccaatttccggtagcagggtaccgaacagaataaagtcgtaaacggcgaatacccaggcgaagaaggcgagccatgtggcgaatttgacatctttgattgttaattgctgcggctgccagccatcagcagatatttttttatagatgttcatggttgttatcactcgttcaataggacgcctcaggatcaaattttgcgcggcatacggcgcaagtagtcgtcagcaatctcatcaaaggtcacgaaacgtacaccctgatggctctggatatgtttgagcaaccgttccagcattaataacacttgcgggcgaccggatacgtcaggatggatggtcatggtaaatacggcataatcatgttctcggtatacccagtcgaactgatcgcgccacatctcttccagatggcggggattaacaaaaccatggctattgggcgctttcttgataaacatcatggggggtaaatcatccaggtaccagttagccgggatctccaccagtgcggtttcggcccctcgttgcaatggtttcatccagtggtctggggacttgctgtaatcgatgcgggtccaatggtcgccgacgcgcacatagtaggggtgaaaatcgtggtgcatcaggctgtggtcatatttaatgccttttttcagcaacagctcgttggtgacgttgctaaattcccaccaaggtgcgacatagcccgtgggcggttttccggtcaattgggtgaggagggcgatacagtgatccagtacggcctcttcttgcgctggtgtcatggcgatagggttttcatggctgtaaccatggatccccacttcgtgtccagccgcggctaccgctttcatttgttcagggaatgtttcgattgagtgacccggaataaaccaggtggcccgcaggttatggtcagcaaagagtttgagcaaccgtggcgtacccacttcaccggagaacataccgcgtgaaatatcatcgggtgagtcctcaccgccataagatcctaaccaaccggccaccgcgtcaacatcaacgccaaacgcacagaatatttctttagccatagttcttctcctgagtttgcgattcatcgcaggtaagttgccaccttgcgtgctgttgtaaaaacgcgggagcagagtagcaggtcaatattggctgccttcctgccactcaaattatttaggggagagtcttcccataaaatgtattttcgagagaaatacagattttaccgtaacaagagaaagaccaagttgttaactaaattgatcaaaatatgatcaataatgtgattgaaacgataaaaacatgttaaaagtgggtgatacaacccgctagttctctctcaaaggccaatgagttgccactcatgacgagcagattttttacggccggtagagaggtaaaataggaaaggttgccctcgttattcagttaatttaatttatcgcctgggtgcaggcagcggataacgtgttgttattcggttgcttgctggatggcatatacctgccatccttcagattgcctgtattattgcgctgataaatgacctttctatctgtgctggtaatatttatggcttcagcgtaaactggctcgcttactcttagactagacgttcagaattaaaatttatgaaaaagaaaacacgatcaaacatttttaagttatcacttctttcaattcctcctctgattgttttatcttttattttgtatattttcatgctgttagctttccccgatacgcttagaaaaattgaaggttggtataaagacaccttcttgacaaaatatattactctgacacaagatgaagctgccaagcagttaaataattatgcgattgttactattgatacctctttatcagagaatataaaaaaatcaaataatattaaattcgtggaactatggtatatgaatcataaaggtggtgactcgataaattcctttcggtatatcgaaatggtcataaagcctatcagtaatcctaacgagaatactcaagtttacctccctgacatgggtgaatataaccttcatagagccaccattaaatttgagggtaattcccccgatgattatggtcacagcgtgacgatcaattttgatagacatgaggccggtcgtagttataaccaatttgttgataggtacttaaaggaagggtcgctcgtaaaaagcggtgaaactatcgtggcatgtgaaaaaaatgacgttgacttgtgtgatgcgaatatccgcttaacagttacatttgacgaaaaatacagtgatagtaacttctttggtaatccaaggccgttgtcgtcaagtggtaaggcctaaattcagagggagactacacggtaacctgatacagcctaaaaaattacaggtataatcccaccaattatccaactggtttagaaacgaagatgacaaaactcaccttacaagagcagatgctaaaagctggattagtgaccagcaaaaaaatggctaaagtccaaagaacggctaaaaaatcacgagctcagactcgtgaggcaagagaggctgtggaggaaaataaaaaagcacaacttgagcgtgataaacagctaagcgaacaacaaaaacaggcggctttatctaaagagtataaagctcaggttaaacagctcattgaaatgaacaaaatcgatatttcaaaaggcaatattggttttaacttcacagataataatttaattaaaaaaatagttgtggataagcttactcaagctcagctgattagtggccgtctcgccattgcccgtttggttgttgataacagcggcgagagtgaatacgcaattatccccgcgagcgtggccgacaaaattgcgcagcgagatgcgagcagtattgtattaaatagcgcgcttagtcaggaagagcaagatggcgaagatccgtatgccgattttaaagtgcctgatgatttgatgtggtaattaacattttgtagaggcttatgttggcaaatactaatctttacaaatactaatctttacaaatactcatagatgaaaagtccctcagggcttttcattaagattttatgttcagccagttaatggaaaaacgcagggttgttctggagagtcgccaacatctttgctgccagccgactggatgacgtcttttggcttccccgctttttatcgtatctacgcgagtcccttttttgtgctgggtgtcaatggggatgatagtcaacttcttgcacttatctgtctagcagaaacgactaaaatgcaaaaacgactgaaatgcaaaaaccctgcttagttacctaggcagggttctttaatttggctcctctgactgggatcgcctttgccagcaactggctaataattaagctaaacctgaattgtatttctgtcaagaccaccataatgaccaccaatagttgcgggttgcataaatctggtttgagctccacgctctgcatatggtggactgatcctacggcactacaaatttaaatccccctcacacgacggggtttgtacgaggcctccgggctgaaaccactgagatggctgtggtgccggactcggttgtaaaagacttgtgtaacgaacggtgcaatagtgatccacacccaacgcctgaaatcagatccagggggtaatctgctctcctgattcaggagagtttatggtcacttttgagacagttatggaaattaaaatcctgcacaagcagggaatgagtagccgggcgattgccagagaactggggatctcccgcaataccgttaaacgttatttgcaggcaaaatctgagccgccaaaatatacgccgcgacctgctgttgcttcactcctggatgaataccgggattatattcgtcaacgcatcgccgatgctcatccttacaaaatcccggcaacggtaatcgctcgcgagatcagagaccagggatatcgtggcggaatgaccattctcagggcattcattcgttctctctcggttcctcaggagcaggagcctgccgttcggttcgaaactgaacccggacgacagatgcaggttgactggggcactatgcgtaatggtcgctcaccgcttcacgtgttcgttgctgttctcggatacagccgaatgctgtacatcgaattcactgacaatatgcgttatgacacgctggagacctgccatcgtaatgcgttccgcttctttggtggtgtgccgcgcgaagtgttgtatgacaatatgaaaactgtggttctgcaacgtgacgcatatcagaccggtcagcaccggttccatccttcgctgtggcagttcggcaaggagatgggcttctctccccgactgtgtcgccccttcagggcacagactaaaggtaaggtggaacggatggtgcagtacacccgtaacagtttttacatcccactaatgactcgcctgcgcccgatggggatcactgtcgatgttgaaacagccaaccgccacggtctgcgctggctgcacgatgtcgctaaccaacgaaagcatgaaacaatccaggcccgtccctgcgatcgctggctcgaagagcagcagtccatgctggcactgcctccggagaaaaaagagtatgacgtgcatcttgatgaaaatctggtgaacttcgacaaacaccccctgcatcatccactctccatctacgactcattctgcagaggagtggcgtgatgatggaactgcaacatcaacgactgatggcgctcgccgggcagttgcaactggaaagccttataagcgcagcgcctgcgctgtcacaacaggcagtagaccaggaatggagttatatggacttcctggagcatctgcttcatgaagaaaaactggcacgtcatcaacgtaaacaggcgatgtatacccgaatggcagccttcccggcggtgaaaacgttcgaagagtatgacttcacattcgccaccggagcaccgcagaagcaactccagtcgttacgctcactcagcttcatagaacgtaatgaaaatatcgtattactggggccatcaggtgtggggaaaacccatctggcaatagcgatgggctatgaagcagtccgtgcaggtatcaaagttcgcttcacaacagcagcagatctgttacttcagttatctacggcacaacgtcagggccgttataaaacgacgcttcagcgtggagtaatggccccccgcctgctcatcattgatgaaataggctatctgccgttcagtcaggaagaagcaaagctgttcttccaggtcatcgctaaacgttacgaaaagagcgcaatgatcctgacatccaatctgccgttcgggcagtgggatcaaacgttcgccggtgatgcagcactgacctcagcgatgctggaccgtatcttacaccactcacatgtcgttcaaatcaaaggagaaagctatcgactcagacagaaacgaaaggccggggttatagcagaagctaatcctgagtaaaacggtggatcaatattgggccgttggtggagatataagtggatcacttttcatccgtcgttgacacaaagtactggttcattacaatctctgcgcggcgataatctgctgcggcataaagcatttcaagctcattccctgtgagcttttcttccatatgcccgacaaccttttccagcaggctgccgtcatttatttaccgcagttttctgacgaattccatcttgtttgccggtttgttcatgtctgacctctggtgtactgactgtaaaaaaggattgccacagcaggagatgtgagcaggttattcatccatgacatggaggcacgggaacctgaaaacaagccggctggtgcatattaaaatgtgcggagctattctcctccgcacatacagatttaacgtctgcgtttctccagtatcgactgacagtcagtacaggttgttacacccggcagcgtctgacggcgtttttccggaatagccttgccgcaaaatcgacagtgctgcagggaaggtgtcggtgtgggtcttaaccggctttgttcaatcagtgcttctaggcaccgttcattaaacgcctgatcgcgatcgatttcatctggcacgttgtattctccttaccgtgttctttctttcgcaatgcgtgatgcagttccagacaacggtcagcgagggggcagtacacgatgaaaggttttctgtaacctgcatcatggcgtccagcgcctccggggaatcaatgttttcgacccgatatttttgccactgatgccagattgcagcatcggtttcttcatccggaatgggtgttctcccgtttggaacggagacaccgagtaaccggcggcgtgcacaggtttctctggagccaaccccgaaataacggttcatcagtgcgattgagccccccagcctgacagctctgttcagttgttcctgacgcctgttttcctcgtgggatgatgccagtaatttttgcaggacatcatggcggatagtaatatcgacaagcggtaaaggtgcctgactgagggtgataagatcgtttattgataagcaaccgagcaaattcatttcatcgtaagtgaatcccatagtttcgcagtgatgaatatttccttcccgtagcgcctgaagagcaacggttaatataatatgattcagggatggaagtatgaaattgactccttaactgaataagtgctcagtaattcagctgaatattcagtgaatggtatagtgtcatatagcacaataccgggcaggtctgaaatatacatgcaggtgcttttttttatacctgcaggatcgaagtttatgagtgccgggatattaatgttcatcatcttctcctcattgcgtctttatcggtcagataactttttgttgatccactcgtcaatctcagactcgagccaggcaacactagcagggcctatttttattgaacggggaaatgcaccctctttcatataaaggtatatctgtgaacgcttcagccctgttttttgctcaacctgtctgaggcgtagtaactgataagatgtcatatatcctcctgtgactgaaataaacggtggccggagaataaaaaaacacagtggaagcctgagagaaagctggtgagccctaaataagggatgcaaaacccttatttagggttgtcggccattacaaatggggatggtattagccggataaggatgtcgaagatggcgaaccacgcttcagcgcatttttcagtgtttcagcgtccagtttttccccgatgccatcgtctgatgcccattgttcaaaaatagaaaggagcttatagggatgattcagcagtgggctgatagtatcattgtgcttgcaggccagccaaaacaggcgtgataacggtgttgtcatacgggaaggtgaaatgggatgactctccctttttttgtataaattaattagtctttcgacttcggtgtggcgaataacaaaacaggcatcaggcggtaatgtataaagaggaaaacacccattgtgattatattttatggtcgtcacttctgttagtttttttatgacatctaatgctgtgttttcaggtagtctggaaatttgtttttctacgcgttctttccaactcatcgtttcgaaaatttgaaaaagctcctctgaaaatcttactataataccatggttagtttttcttgcccccacaattggggaggggaatttaagttcacgtgccagtatgcgctgaatcaaaacatattcatagcctatcaggggggtatctataatttgttgcacaggacaaacatatctggcttctgtacagagtcttaaattttgaccataaataaaaccgtccctgtcaagcatgcatagtttatcaagtaggtctccctcaaactgcctgaattttatttttccattaaaagtttgtatcttcttaagtatcacaggagactggaaatagaccgatagtaggatgttgccactcaaggcatgacgataaatatcgctaggagtaattttttgttttatggctttggtagtgatctcaactgcttccgttatagtgacccatgttgacatataatgagttataagcaatggctgatatttttttgacataatattatctccttctacacaacaattcgttccgttaaggaaaaagattggtgtcacaagtatttatttatgattaatcagagggtttatgacagagaaaaggatgtatatttctgagtgaacatgtacaggcctatggggtgactatttaatgagtaaatgccgaatgattttcggggtgatgattataacttgaggaaaaatcccagcgtggtttgagtagtgtacctgagtgatatttgtgttatgtatgcattgattgcagcagaataaatatagttcaggctagtatagtttgtggtagctatgagaatatataatctattttacctataaaataatttatatgtatggggtggttttttttgtggcgaattggttttactgaaccctaacttttgatttttaagtttgcacttattgatatgttaatatgataaatgctttatatcagttttactctacagaatttcaaaaaaatagatgtgttaatgactgtttttgccgatgaaatctttgagttttcgaaattgttttgagttgagggtgtgtaattgtaaaggttttattaattcgggttgttttttttaggttgtttgtctgtgcttttatattctggagatgtgccttgtatataggattgtttgttggttgtatttttaatgttgcactgttgtgaatttttattttgatatgattatttctttagtataaggagagaaaggaacgagaaagttaaatctatttgtcctaatcgcaatttcattgtttaaataatcactatggattaatattttttgcgactctgctgagttactggttttaactagtggtgtaaaagggataccttttcggtatcccttttacaataatcagaagaaatcaattcgcgtattgataccgacggtgcgacccatattgacctgcgcgacggcgctgctgccgttcatgtagccataggtacggtaacgacggtcgaacaggttatcgacatagacggaaatgttcatccgttcagtcgcctgccagcccaggctgctgtccagggtggcataggtgccttgccgcaactggttgtcgccatcgaaataatgcggcccgaccagattaaccgccagtcggggcatcagtgcgccatagcgcgtatcaatcacgccgttcacgctgcttcccgcgccataacgtggtacgaacggcacccggttaccgtgatacaactcactgtcattggtgaattcggaacggatcacgttgccattgatatcccatgaccagcctggcgcaaaccgccacttcgcttcaagctcaacgccggtggcgtcggctttacccgcattgcttaatgtctgcatcccgaccgggccagagtaaagctgcatgtctttggtgtgggtataaaacgtcgcggcttgcagcgtgacgtcagcggtttcgtagcgggtgccaagttcatagttgatggatttctcggcgacgaacggtttggcatcaagacccgcagtaggcacgatgttgtacccggaaggtttatatccctgggctacacgggtatacactctccagtcatcggtcagcatatagcctgcggatagctgcccgagcacctgatcgtcattgctcttaccctggtcgccaaacgggttgccgagcatgctgccgtgatattgtgtactggatttatcatgcgagaagcgcacgccgccgccgatatcaaaacgatcggttaaatgccaggtcaggtcactgtatgcggccagcgtttcagcggtggtatagccggtactgcttaaataaggcattgtcggcatgtcgtaggctgaatttaacttctcgcgggtgttctgccggtacagcccaaacaccatatcaacggtacgcgcatcgcccagggttgcggcgcgcagctcctgcacatcctgattccagcgctgaggcatattgacgattaacgaaccggaagggaaggtgcgcgaataatgctgctgctgccaggcgctgatcaggttgaaaacccagtcatcggtggtgtatttcccactcagggtctggctgtcagtgcagcgccgcatgtacgggtctggtgaaccatcgctgatcgacagcttacggcccttaatatcattccatcccacataggcgtcctgggtggcgcgggtacattcgcgtgaggcggcaaagcccatttcccagggctgatcgtccggcgccagacgcagtttcacattccctatgctggcgcgggtgccgcctaagtcatcgcttcccgtcgcggggttaatcatgtcgccgtcatcaacctggcgtaacagggtgacgctgccgtacagcaggccatcctgaatggggccgctcaggttgaacttacttcgataactgtcgcggctactgacgccgccttcaatatagccgcgcggcgtgctgtccggctgctgggtgacgatgttgatgatcccgccctgagcgcttttgccatataacgttccctgtgggcctcgcagcaactccacgctttgcacatcggtaagcgcctggatggtgttggtggaaagctgagggacgccatcgacatacagggtgacggcggggttatagaagtcctgcgctgaagagacgccgcgtagcgagatcgtcgaaaaaagcatgttgccgctattttcaatattgagcccgggcaagactctggggagtttgtcgctggcggtgacgccggcgtcgcttaattccggcgcgctgacaacagtagacgagacgttgttggctgatgccgagcgggaagattgtttactggcggtaaccaccagcgtgctttcgtcttgctgtgaagtctgggcattagcaatggcggggagcaataatccccccaaggccagaggataaagccgtgtcattttcattgttgtgagtccctgtaagacggcgaaacgccaaaaataccgacaatggtgaattgaaaatgataactatttctaatagtggtgctacccgaaacgggtttatttcaacctgtttcgggtcggtttgcgcttattgggcagaatggcgataacggtcgacggcgagagccgtcaggcgttttttgtctatcttgccgacggcggtgagcggccagtggtccagaaactcgatttggtcaggaattttccacgcgctgagccccatacgggtcagttgttgacgcaactgctgatagtcagttggcacctgctgcgcgatgataaacgcgcaaatccgctcgccaagcagcgtgtccggcgcggcgaccaccgcgcaatcttgcacttccgctaaacgcagcagtgccgattccacttcagccgcggctattttttctccggcgcggttgatctgctcttttatgcgtccctcaacgtgcaggttccccacctcatccagcctgacattgtcgcctgtgcggtaaaacccttgcgcggtaaaggcctgcgcgttgtgggcaggggcgcggtaatagcccgaaatggtataagggccgcgcgttaacaattgcccggtttcgcccggcgcgacgtcgttctcgtcttgatcaacgatgcggatttcatccagaggggacaacgggcgcccctggctgtggagaatggtggcatgcggatcgtccagccgggtaaaacagagcaggccttccgccataccgaaaacctgttgcagggtacagtcaaaggtggcgataacctgctcagcaagcgtcgggtcgagccgggcgccgcctgcctgaatgacgcgcagcgacgaaaggtcgctgtcttcccactccctggcctgcacccataattgcgccagcgccggaaccagggcgacgtgagtcactctttcctgcgcgattaaaggcatcacctcatcacagctggcgctgtcggtcagcaccacttttccgccgcaggcaagcgttcccagaataccggggcaggccagcggaaagttatgcgccaccgggaggacggcgagatacacgctctgttggctgatgccgcacagttcagcagaagcgctgaagttatagctatagtcggcatgtcggcgcgggatgagtttgggcgtgccggttgtgccgcctgagagcaacaacaacgcggtggcggaaacatcaggctgcggccatgcctgtcgctcaccgtgaagggagaagagcggcgtaaaatcgtcgctcacggtctctccagcgaccagaacatgacgcaagcaggcgtgtttgtgcgccatctgtcgggccagctctgcgtggttttccccgtgaataacgtaagcgacgggttgcgccagctcaatcagcgcgtcgatatccagcgcccgttgcgagggcatcgccagcacggggataacgcccagtcttaacaaggcgaacagcagggtaacaaacgcgttgtcgttgggaagctgcacaattacatgctcccccgaacgcaaacccagtgatgacagacctgcggcaagttcgtcaacttgtgcatcaagcgcgctgtaggttaacgacccctttgcatcaacgacggcaattcgcgaggcataacgggccgcccagtggcgcaactgttcggcaatgggtaagggatactgttcaatcagagattcaaaggaagaattcatgcgtcacctttctgaagtactgggctgtttttgcaacgcggtcattgcagaaaatgcgtggggaaaatggcggacaatctgcgtaaaaaaggaccgggcttgttgaatgggatagaaatgatcgccgtcaatcaccaccgggcctgtaacgtggctcagccactgacgccaggcatcgacctgctgccaggaggcttcgcgatcgtggctgccgcacaataacagcgcaggcgtgcgcagcggcggacagacgtcgggcgagtcgtagtgatagctctcggtggcgtaaaaatcagcgcgcagaagaggaagaaacagcgacattaattcctggttttcccgcagttcaggagaacatccgccaatgtctatcagctcagcgataaagtcggcatcatcgcgatggctgagctggcgttcagaatgcagatgcggggcatggcacccggaaataatcagtccttgtggcgcaagcccccgttgctccagaagtcggcaggtttcaaacgccacctgcgcccccatgctgtgcccggcgagtaaaagcggcgtgtcaggcgatacggatgcttccagctcgttcgccagcagtgccgccagttgtgtaatgcttctgagcggttccagatggcgaaggcgatcgcgccccggccaggtcaccagagaaagcgcgcaatcagtcagttgctcagcttgccagtggcgaaacgcgctactgctgccgccagcgaaagggcacatgaccagatgcgcagtattgccgttccgggcgggccacagcgggatgcacattgcagattgcgtcacagcgcctccttatcatcatcgttgtagaaaccggctaaccggtcgtggtgcggcggcgtcaggcgtctgatctccgcattgccggtcttacgtaaaatctgctgccataaacgtgataacgcgatctgatgtacgctttggcaggccgctggtggatgttcgcccgccagatggctgcgcaactggtgtagcaaccagctgacgccctccggcccgacggtttcgcagcagtcgcgccagctcaggggcgccgcgctgcgcgtcagacccggcagatcgcgcaggatctccggtctgcggtagaggctgtgggcgttctcctgatggtctgcgacaaacaggctggatgaccagatgacggggccgtagctcgcctccagcgaaagatgaccttccggccagcccagcagcaggcggtgcatgataaggctatgcatatctggatcgtcaggatcgagatagcgctgaagcagcaggcaggcttctccctccggccagaagagtctcagacagtgaaaatcgctaaagctgccaaccacgtcgcactccacggcggcggcatcaacgcccagagccagcaacaacaaatccagagtggagtagagcaactgtcggctggtggtggcgtggactaccggcggcgtcttagccaggcagcgacgcagctgctgcgcatcacgaagccatgtgcgtcccgcgcgcgtatgcggataaaacgtgtttacccaatagcagcagccctgttcctgcgccagcgtttgtaaggaactgatgtcatccgggtggaggggatgctcctgaatgacgtgtacgccgcgcgtcagaaagtgtctggcaagctgcgtaccggttcctccggcgacggtcgaacgcacgacaatacaggcgatatccggcatcctggttatctgttccggcgaggtatacagcggaatgccaaacgcatgagccagctctcttgaacgggcgcttccctgcgccagcaggccgaccagttccagcccctccgggggctgcataaaggcattcaggtacatttcgccaaatttggcgcccacaatcagtacgcgttgttttggggaggcggacggcatcataacgtgttctccggttgcgttgaggttgcggaaagccagcgcgtaatgtgttgcgcacaagcctgaacgtggggggcttccatcatgatttgccagtggctggcttcaatcacagcgtcgtcggcgttgtttatccagccctgccactcggtttctgctggcgtccagcgcgcgggtctcccggcggcatacaccatgagacaggggaccggaacgctttcgcccggcgtatgctcagtcagtaaacgcagcagatgcgcgatgttgtcgagccacgtttctgccgcttgcagcgtcaggttttgcgacaccataccggccgttttagcgaggctgataaagtcggcaagctggctgtcgggcgtctgctggtcgaaatgttcgggcagtgccagaggcgtttgtccttcggctaacaggcgcagcagggccgcccggttttcgcaacagaaatcctgtcggcacacgggatcgattaacaccatccgaacctgctcgcctttggcgtacaggcgctgtgcggcgcccgccgcaagaaacgcgccatacgaccaacccgccagcacataagggccgtgaggctgctgacgacggatgcacccgacatactcatcgatcatctggtcgagcgtggcaaagcgctgcggcgattttgcttgcaggccgaaaacgcgcctgttcaacgcgctagcgagcggcagccaggcgctgatatcgccgtctgaagcgtggaagacaaacagggtttcctcaccgtcgccctggcaaaggggtatcgggttgtcctctcctgacgtagccgcctgtagatgggcgcagaagtcgctcagcgtcgaatggctgaacagatcctgaaggttagccctggcaatccctctccggtttagctgcgcgaccatccttgtcgccatcaggctgtcgccgcccagttcgaaaaagtcgtgatgccttgccacggggcgagacagcagcgattgccagagttcagccacctgtttttccagcgccggattccccccggcaactggcgtgggtttggctggctcagtcggcgcatcagacggggcatgcagcggcgtaaataacgcttctctttgccggatctgtaaaatgggcagaccggtgccaaagcgctgctgtaaatagcggctcacggcttttttatccgggcgatttacgccaggcgaacgcgccaccagcagatgctggcgcagcggcgacgattcctgcgcgggccacgccagctcgtttgcaaacccggcctgaacgagaacctcctgccatgcggagcgggtgagcatcggtttctcatcccggcggcggaaatcgcggtatccgcttaatccctcaataaagcccacgctcgccagctggaatacgctgtttcgctccgtcgcttcaacgatcagcaaacgtccgccggctttcagcaacagttttaatctgcgcaacgtctggacgacatggctggcgtcgtggagcacattgacggcaacgatcaggtcgtaacccgcctccgggtgggcggtgaaatccagcggctggttgatgtcgaacaaggcataagacacctgcgattcatcatggaaacgggctctggcgtcattgaggaactgcgcggagacgtccgtgaagtggtacgactgccgcgtgttccgcgtggccttcagcaccggcgcggtagtggctgcggttccggcgccaacctccagaatccgttctgcgctgcacaaggcggcaatctgcgcggtatagcgattcagacaggcgctggcggggttgtcgcgatacagcgcgtcggtaacgcgatgctgctcgttgaacagcaattccagcggagaacactgcccggagaagagggcgtcgtgccgggcgatgcaggtttccagatactgcgccagcgcctggctccattggctttgcgggcacgcttcctgaggctcaggaatctcgctgagcggaatgcggcagcgccagctttcaccttcgcggattaaccactctctttccgtcagacactgtagccactggcgcagcagacgctggtgagacgcttgcgcggacagcgcctgtactattgcgctaaagcgatgggcgatctccggcgtggtaaacaggccgtgacgatttagcgtagccgcgatcccctgtagcgcacgcgcctccagccagcgccaggtcgcctccagctcatcaagctgcgcctgctcaggcaacggcagcgccagttgggtaagttcgtgctcatcaggcatcgccgctgatggcgacggatcgtcggccatcacgatatccagcgtcaacgcgccctgttcggttatttccgctctggcctgccggatgccggggtattcgagcgtcgcctgctcaatatcccgcaggtcgtagtccgcctgcgcgttcagcggccagcgtcggcggggaatgtgcccggcgatgccgctggcgagagtcttcaggctttcaggggcggcgatgacggcttgcaggatggcgcaatagtcattaaacatcgcctcggcagcgccgggttccagcacgttgtccatgcagtaccagctaaacatcaactcgccgtcgctctccatgacctgatgatccagccagacctgcggcgtttgcgtgaatacatagcagggttcgccgaacagatggctcatcgcctgatcgatagtcatgccttccagcgtcatccccagcatactggtaaacactaccggcatcagcggttgacgttgtgatccgcgcaggcggcccagctcacggatcacctcaacaccgttcatttcactgtgcgccatgttttgccagaggcgctgttgggtctgttgcatctgctcttgcaacgtcaccggcgctgagaagttaaaatcaaccagcgtgacggaggtaaaatcaccaatcaactggttgatttgcggatggatcggctggcgattgaagaacgtcaggttcagcgtaaatgttgtggtacggctccagcgctcaagggtggcggcaaacagcgtgagcagcgcggcagacggtgtgacgccttgctgctgccagcgctgtttcacggcctgccattctgtcttgccgatcgtcgatttgaaggtggtgaagtgtggcgtttccgggggcgtctcaaccaccggcagctctggcgctaagggcagttgcggcagtttttcctgccagtaatcccaggcatcgtgccatgccgatgtctgtcggcgcgcctgttcagccatcacataatcacggaaggtaatagcgagcggcgccagcgtttcaccgcgccagacctgcgccaggtcgtccatcatgactttaaaactctgcacatcaaactgcaaaaggtcgaggttcatatgcagacggtaatggcaatcgtcgatttcgctgaccaccagctcaaaaagaggccactggtcggcaggcaaaacgcgatagctcagttcatgccgccgtttttccagcgcgatgcgctgttcttccggggaaagcgcgcgcagatcgtcacgcgggatgtgatactccggcgttgtcgccaggattcgctgctgcccgtcggcatcaaccaccatacgcaacatatcgtggcgtgcgatgagctggttccatgctttctccagtatggcgagatcgaactcatcgtggcgtttatcccactcaaacaggacgtgacaggcgacgccgccatagccaatgaggtgggttcgccccagccagtaggcgtgctgaatgggcgtcaaagggaagggcgcataacgctcgtcggcgtcgtgccgcaacacttccggctgcgaagcggcaggcgtcgcctctggcttagaacagataagctgcgtgagtccatgaggagacagatcctgccacgcccgttccgcattgatgcgtacgcccaggtagtgctgaatatcgctactgagttcaaggaagagcagcgagtccatgccgagttgcaacagatcctggtttggatgcagtgacgccggatcgctcagccttagctgaaccgcaatccgctttttcagccatgccatcaccgctgtttcatcgctcaggctgccgttaaaggcgttgtcatcagcaggaggaatgaccggcgttgcggctttttctgtggcgctgatgttaaacagagcctgttgtaacgggggcattttgtcggtaaaaacgcgcatcgccagtcgccacggggcgccgcgcatcaccgcctgttccaggtgccagcagccttcggcatcgcttaacgcgcccatacctcggctggcgagcgtcgccagcatttccggcgtggccgcccgaccgctttctccccatgcgccccaggcgacagagagcgttttcggcgcatcaagggtggaaaactgctgggccagcccgtccaggtagccgcaggccagcgcatgggcgctctgacccggcgcgccgagggtggcggcagcggaagagtagagaataagatagcgtccgtcgtggttgcgcagggtttgcaacagctggcttgccgcctgcgcttttaccgcgaaaacggcagccagctggtggtcatcaagctcctgcaagggcgcgtcagccaagacgccagcggcatgaatcgctccggcaatgccgccgttggccgccagatcgtcaagaaccgtggccagttgcccggcatcgcccacatcacaacggcagacgcgcgtctgcccgccctccacgtcgcgtagccatgactcatccacgcgcggcgccagcagggcgatgcgtcgcgcccctttttctctgagccagttcacggcaaggcggcctaatccgccaaacgctccggtcaccagatgccagcggctatcgccggtaaacacgtttgccggtaattcagcggcgcatcccgtattgggcgccagtgaagggagccaaagggtgtcaccccgtgcggcgagccagcgctgtgatagtgagactgcgctcaacccttgatgcagcgtttcccacggggtgttttcggcgagatcgatggcggcaagcaaccgttccggctgttcgttggccgcgacgcgaagcaaggcccatagcgcgtgatgggatgcagagagtgcttcattttcctcgactcgccacgcgcggcgagtaaccacaatcaatccggctgcgctggcggtgagcgctgctatcactttctccgctaaggccagcgtatcctcgctctcctcaacaatcatcagtcgcgaagaggcgtgcggatcgtgaatgatgccgtattgcgccagctcgtcgctgcgcgcaagcgtaccggcgctgaagctaaaggtaagcggatggtcaatgctggcgacgttgaggggcgtccagcgccattgataatgcgtctgcggcgcaggaagaggcgcggcgggcgatagcggcagccactcgccagtaggatgacgggcttcaacgcgcatctgaccgcgggaaaaggcttcgttttgccagcttaagcgaaccttccccagccactccggggcggcgacggggggcggttccacaggcagagcgtcgccatgacgctgtgaaagcagacgccaggcctcctgccagcgggcgttaaaccgttcgggctgacctgcgcaatcagaccagtcggcgagataatcaccgttatccgtcagcgcctgccccaacacgggttctgatggcgcggtgaatgttacggcgctaaccgcctgaccgggcagcgtggcgagaatgatatgttcgctcatcccggcggtcgggctgccatcctgcggtagccacgccactttgctgaatccggcgtggcggcactgttgttgccactgagcggtggtgaggaataactcaccttcgcgggcgtcgagatcctgtagcggaagaaccagcgggccgaaaacgaagtcaaacagacgcattggctgggtgatttcgcgcatcagcaggcgcccgcccggcttgagcagggggcgcagattatcgagcgtgcggccaatatggcgggtggcgtgaatcacgttcgctgccacgataagatcgtaagactgtgcctggaaaccctgagactgcgcctctttttcgagatccagctcgctatacttcacaaaatcatagtcggcgaatttctgctgggcgcgacgggtgaacagcgccgagatatcggtgaaatggtactccagtgccggaacgccgttgagttccggcagcagccacgcggtggtgccgccggttccgccgccaacttcaagaatacgcaacggctggcggggctgacgcgtctggacaatgccgcgtaataccccggcggcgatttggttgaaatagcggccaaagctgaattcctgatacagcacttccacgccgtcggaggcgctttgcgggaagataatcgccaccggttcttccgcgccgctcatcatttcatataaccgatcgccggcacgggcgatggtgtcgggaatagcctgaaaaccttcacaataaccggcaagttccgtcagcagtgattcccgctgttgatgttcaatggggcgggcgcggacgtatcgcccgtcggtgcagcggtaatcgccgtcgaccacgcagttattcagcaggcgctggagtagctgctggtagcggggcagcagacgtccacggcgcatgatggtcatggcgtccacgccgttctcaatggcatcgccggtacagcgttgtaccagttgatcgacgtagatggcgtgcagtcgcgtggcgcactgtttaagcgcttccaggcgagggagatcgagcgctgtcgcggcgcgactcgccacctccagcccggcagacagcgctgcgtcggcaggctcgcaggccggggagacgcgctctttccagtaacgctcagtatcaaacggataacatggcgcagcgatacgttgtccatcgcccgccagcaggtcggcccacggtagggcgacgccggcagcgtaaagctggagcagggcctgattgaggacatcgctcgcctctttgttacgccgggcgctggctatccagtatgcgttatcgcggtattcgcgctgcccgcaagcaaccaactgggcatcgggccccatctccagaaaaacgcgggcgccgagctgatgcgccacctgaatactctggataaaacgcaccggctggcgcatgtgtcggcgccagtaatccgcctggttgagcgttgactcatcaatgacgtcggcggtgagcgtggaaataatcggtatttgccccggctccgcgtgcagtcccgcgcaggcgtcctggaaccgatcgagtatcggctccagtaaagcggagtgcgccgcaccggttacgctcaggcgacgatagttaatgtcatgctgcgagagcgtggcgcaaaataccgcgagacgggcttccggcccggaaaataccgtatgttgcgtaccgttgttggcggcgagatccagctcaaactggcgagccagcggcatcagcgtgtcttcgtctgcaaataccgccaccatcgcgccgcttgcgcactgctgcattagcgcgccgcgccgacaaaccagtggcatgacctgttcaatcgtatagtgtccgcagacaacggcagcggcaaattcaccgacggaatgcccaatggcgaagtctggcttcagtccttcagcacgccagtgcgccgccatcgcgatttcaaacgcgacaatcgccggctgcgcccaggccatattgtccagctgcgccgaatcggggttaaacatcgcttcgcgcagtgacggcgtgagcatttcgctacaggcggaaaaacagcgatccagcgtgtcggcaaacgccgttgagtgctggtacatcgtttgacccatagtgcgccagtgcgagccctggccggtaaacagccacacctgcttgccgctggcgccgtggccgctgtaaaccagcgcccccgatttctcaccggcccaggcgctgagcgcctcggcggtttcacggtttaatggcgccgccaggcggaaggggagatcgagacggcgcgcgtgcagggctgtgaaggccagagagctggcatccgcattctctctcagcgccccggcataatccgtcgccagccgccgcaacgcgctgtcgctggcggcgctgagcagcagcgcggtactttttctgccgctatccgtattggggaggcgcgcgttgagcgcgtcgggcagcgaggcgacgatcatatggcagttggtgccgccaataccaaaggaggagacgccagcatagcgcatttcgtcctgccatgcctgtgccgacaccggtatggtaaaggggctctcttcaagtttcagcgccgggttgggggtgtgaaaattcagtaagggaggaatttgcccgcgactgactgccagaacggttttcagcagtccggcaatgcccgccgcggtatccagatggcccatgttacttttcacggaaccgagcgcacagcgctgatcctgcgggcgaggcgcatagacgttgcgtaacgcttcaatttcaatcgcgtcgcccagcggtgtgccggtgccgtgggtttcaatgtaacctacctgcctgtcgtcgatggccgccagcattaacgcctcttcgatgactgcctgttgccctgcgacggaaggggcggtatagccgacctttctgttgccgtcgttgttgaccgcgctggagaggatcaccgagataatcggatcgcctgacagcagcgcgtctctcaggcgacgcagcaccacgcagccgagaccgttaccggcccaggtgccctcagccgaggcgtcaaagggacgacagtgaccatcaggagagaaaatcattccgggctggtagcggtagcctgcctgctgggggaaagagagcgccacgccgccggcaaccgccatatcggattcgcctgcgcgcaggctttcacaggccagatgcacggcaaccagcgagctggagcaggcggtctgtaccgataacgccgggccgtgcaggttgagtttgtacgcggcgcgggtggcaatatagtctttatcattgcccatcagagattgcagaccttttacctgcgcgacttctgtcacgttcaatgcttcgcgaccggggtaggtactcatccgggaagaggcgaaaacgccggtcttatgggggacggcgccgggggcataaccggcatgttccagcgcatgccagaccgcctgcaaaaataggcgctgctgcgggtccatcgactccgcttcctgtcgcgaatagccaaacagggtggcgtcgaagcagtcggcgttgtctaacaccgtaccgatattgacataatgaggatcgtcaatgatggcggcatccagaccgacggccagaagctcttcgcgcgtaaagcgtcggctgcattcacgaccttccagcagattttgccagaacgtttcgccatccggcgattcaggaaaatggcaggcgtagccgataaccgcgacaggttcgcagtccgggtagtgttgagcgatcgatgcatcaatggaatctgctgtcggcgcagaagagaagcgcaagttatccataatcggtcccgtttcctaagattcacaaagtcaatggaacgccatgcgttcgcgatggcgttccggggaaaatcagtttgcttcgcgctatatccgccgctgacgacggcgaacagggcgaggtcgttttgttttctccaccgtggcgacgccggccagataatcggccagggcagcaggagaagggtgggtgaagaggtcaagcaacgtcagggtggaaaattcgtgacgttgtaacaaaacgtgcagttgcaccagattcagcgacgttgcgcctgcctcaaagaagttttctgcgggcgtgacagactcgccaaccacctcgcggaaggcgtcgcaaatcaggctgacggtgctctcgtccgccgcaatgtgtggctgagagtgctcagggcatacgcgcggtgagcgctctgcgcattgccctgcgtgtttaacgggaggcaccagcgcggcgagcggcagttgccagccgctttcatcctcggccattcggtttagcaatgcgcaatactgttcaaactggcgctccacctgcccggcaggaaacagcgcggcgacaaaatcccagttaaagcgcagttcgccttcggattcataaatctggtgatcgagccagacctgcggcgtctgggagatgccccagaccggtttgagcagattacgccgggcgaggaagttatcctgctcaaagcccagcgcgctggtaaagacgacgggcatcggaacggcaggcacgttttgccgttgcgccagttgacgcatcacgcggatggctgacacatcgcggtggttgaggttctggctcagccgctgctgtagtgactgcgcgctgtgcagccagctttcgccgggatgccagctcagcagcatcagcgaggtgaaatcgcccagaatctggttgatttgcgggtgcagcggtcgcctgtcgaaaagcgtaaggttaagcgtgaactcaggctgtgcactccatgcagagagaaccgttgaccacaccgacaacagtacggccgacggggtgagatgggcgtcagccgcccgttttttcagccgatgccagcgcgtgctgtccagcgcgccgttcaggcgggcgaagcgcggtgtttcaacctcctgaggcaagcagcgcagcggcaacgcaggcgccggaggaatatcatcaagctgcgcctgccaccatgccagagaatctggattgggcgactgtagcgagggttgttgcagataatccctgaaggtgacgggcagcggcggaagcagctgttgcgggtagcggtagccgtgctccagctccgccagcaggatctgcatgctcagaccgtcaagcaacaggttatccagacacagccacaggcgggcaggcatcccgtccacgtatccgacctggagatcgaataccggccacacttcggggttgagtacctgatgcgccagtttttcgcgcacccgcaacgcctcttcaggcgtatggagggtgtgtgcgggtatcacccaggggggcgtctgttcgagcacctgttgctgtccatcacgcacgatggcgcgcagcatatcgtggcgggcgattaatcggttccagaccgtctccagccgggtgaggtccagatcggcaatttcaaattcaacaaagaaatgtgagccgacgccgcccagggcaaagcccggctgacgccccaccaggtaagcctgctgcacgtcggtaagcgcaaagggctggtagcgatcttcaggggagtggacgaatggttgttcgaccgggacgtcggttttccgcagcgtggcggcaaaatccgccagccggggatgattaaacaggtcgcttaattgcgcttcataacctgcctgatgaagttgcccggtcagacgggtcgccagcaggctatcgccgccttgctggaagaagtcggtttctctggtgacattgccagttgataagagttgctgccagagggcggcaacctgtttttcaatgtcgccctggggtaaatccgcttcggccgggttttccgcttcaggggtatgacgacgcttcagcgcctggtagtcaattttcccgttagccgtcagcggtaaggcgtcgaggaagacgatccgttgcggcaccatccaccccggcagacgtccggcgagggcggcctgaagttgacggggatcgcggcgcacctgcctgtcaggacattgtacgaggaagcgttgtaaccccgcgacctcatcgccatgctgacagttgaaggcggccgcgctaaataatgccgcccagtcggcgctgttatgcagcaaggcctccggctgcccattggttaacaggagcgtgctgagcagggcggacggcgttaactggcgaaactccatcacgtagagcagcgcgccgggaacggcaagctgttgtaatgtcgcaaggagcccgggatcttccggcagcagacgatgcagggcgttattaagccagataatgtccgccgagtgagcgtgcgccgccagcgtgtctgcattccagagggacagacgggcgccaggccagggggcgagcctctgccgggcgctcagcagcatctcctggctctgctcaagcccgacatactcaatctgtccggcgttgagctgtgctaacagcgattctgcggcgcggccagtgcgggttcccacctcaagcaggcgtaccgggcgctgtaagcgctgtgcaagctgttggcaaattgtcgccagttcctgaatatacggggcgctggccggatggttaaaggccaggctttccggcgaccactgcgcgtcgttcagtaacgacagttcgttacgggcaccgcgaagaatttgcgataacgttaaatcatgtccgctgaagtgcggatgctcatcctcgcgttcttcaccagcgcagacctgataaccttcagcagcgggcttcagtcgccgttgtgtcaccagaaatgctaaccagcgttccaccacggcctgccagcgcggctggatagcgagtgagttcatcagggggagaggatcggcgccagcggtgtgacccggcttcagttttagcaggcgatgctgaaggaaatcggctacctgttctgcggagatctctggcgagatggcgcaacagggcaacgttcccgcaagcgtgtgccacgcctgcggcagtgccgggttccgatgatcggtaacgcaaaaagcctcgccctgaggaacaacgtatgccgccagcgttttttctttttcgccgatcgccagaacggttgcttgtttcacccccgccagctggctgagcgcgctttcgatttcgcccagctcgatgcgatatcctccgactttgacctgcttgtcgcgacgaccgaggaactcgattgtgccatctggccagtagcagccgagatcgccggtgcgataccagcgctcgtccgggagcgtcaaaaattgctgctcgctacgcaggggatcgttgaaatagccttccgcgaccccaatgccgccaatccataattcacccggcacccagtcagggcagtcccggccctgttcatccaccacccggtagcgttggttggttagcggaaaaccgtaagggatggagcgccagtgggcggggacgtcgtgaatttcgcaggcgttagaccagatagacgcctcggtggcgccgcccatcgcgataaattgtccttgtggccggaaggcccgataacgggcggggaggtcaagcccgatccagtcgccggaaagcatcactgcgcgcaggttttccggcgtggcgtcggcgaaaccttcacaccaggtcagcagcatatcgaacagcgccgggacgctgttccagagcgtgacctgatggcgctggatcagctcacaccatgcgtgaggatcgcgccgttgattttccatcaccatcaccagcgcgccgcccgcgcgcagtacgccaaaaatgtcgtaaaccgataaatcaaaatgtagggcggagagggccagcaccctgtcatgcgggccaacctgatagcgggtattgatatcgcaacaggtgttaagcgctccccggtgagaaatgactacccctttcggcgtaccggtagagccggaggtgtagataatgtaggccggttgcgtgggggcgcgtactaccgggttggcgatcggctccgcctcaatggcctgctgccaggcaaggacgggaatatcgtctgacccggcgctggcgtcgtgctgacaaatgagcaccagccggacgctggcgtcagcgtagattttctcgcgccgtgcggcaggctgatccagcgaaaccggaacgtaaaccgccccggccagcaggacggccagaaccgcaacaagttgtcctgcgcctttcgacatcgtgatagccacattatcgccgggctgaaccccgcactcgattaacctgcccgcgcaacggcgggcatagtctgtcagctcatgataattccactgataacgcatgtccgttaccgccagcgcctgcggctgttgcagagcgatacggaaaatgccttcatgcagcaagccttcgggaatgggggcgccggtggcgttgacccgttcgcgtatcgcgcgctggctggcgggcatcatatctgcgaacggcttttgccaggcgctttcgtcatcgcagagttggttaatcaactggcagtaggcgtcgaacaatgtttcgactaacgccggagggaacagcgcgtcgttgctgtcccattgtagccagacctcgccgtgatgctcgaacgccagatgatctatccagacctgcggcgtttgcgagatgccccattccggctcgcccaacggcgattctgcgcggctgctgtagagggaacgccccagattgctggtaaataccaccggggcgccgtgggggtagcgctgctggcgtttgagttcacggagtaattcgacgccggaccagtggcgatgctcccagtcctccgtaaacgtgagctggtttttacgcgccaggttgctgacggtatcgccatcgcaggcggtatccagcagaagaatattggtgaagtcggcaagcatcgcgccaaccgccgggtgcagcggctggcggtcgaataaggtgatgttaagcagcagacgcgtcaggccgccccagcgagccagcacggcagaaaaacaggtcgccagcgccattgtcggcgtcacgccatactcgccggcccggttgctaaaggcgtgccagcgtgttgccgggacaatcatgcggcgtcgggtattacggacttcacgtagcgtggcgggttcgcaggccagcggcaagacgggcgcggggggaagcgtcgatgctttcgccagccagtaagcgcgcgcgtcgtctctcagtggttgattgatcttctgctggtgcagcaaatacgagcggaaatcatagcgggtgtcgatagccggcagcgattctccggccagcagggcgttaagctcatcgaagaaaagcgtaaagctggaggcatccataatcagcaggtcaatattgacatggaggcggtggcgattgtccggcaagagcgtcagctgaaaatcaaacgtttcgccgatttccacgcgtaaaagacggtggctcaggcgctggcgcagtgcgtccagataggcctggcggctttcagcgtcgttatggcgtaaatcatgaacggtgacgccgttccagtaaggttgcggtagccagacctgctgcccgtcggggcgaaaggcgatatgcagcattgggtggcgttgcagcaaggtcgtgatggcctgctccagctgcgacgccgtcagacaatggccttcaaactcctgatacaggtggcaacccacgccgccaagcgtctgccccggcatgcggcccgtcaggtaggcgtgctgtactggcgtcaatgggaagggggtactttcggtcatgttcggccaggatgattcgtcgggcggcgtttcttcttccgcgttctcaggcgaccggctgagcattaactggttccatgccgccagcgtgggggcggcatacagctcgcgaagggtaaggcggtagccatttttacgaaaccagtgtaaccatctcatcaatcttatggaatccaggccggcctggatcaggttgctctcttcatgtaactgctgcggcgttaaattcagttcctgtatgagccgctcgcgtaattgttggtaatcagccgcgtggcggttgtccggtaacagcgaatcctgagatggtgcgccagaaatcattcttcctcctgatggcacgtcttaccgaaaagcattgctcatatgataataataattattaacaattggatgctacccgaaacgggtttatttatgcccgtttcgggttggtaacaggcggaaagaacagaggcccggatggggtatccgggcctctgtcagggaggagtttaggggggtgcgaccccggttacatcacgcgtttaaaggtcgaaggggttacgccaaactgtttctggaaggcggcagagaaatggctggcgttggcatagcccagatcggccgccaccgtcatgacggaggtattgccgttggccaggcgtcttctggcttcctgcattcgttcagcctgaaacaggccatagacgctgttgttgaacagaacgcggaagcctcgcttaattttgagaacgctcagaccggactctctggccagctccgcgacgcccggcgcttgcgtcagatcagccagcagcagatccttcgcccgcagcagtttctggcgttccatcgggttgaagtggcaggagaggcaactggcgtcttcgcgatgttcatccagcaccagactgagcatgaccagactttgcccctgcaaccatagcgtcgacggcttttgttcatgactgaagccgccgtgcatgcgcatcagcgcgtgacgcaaggcctgagccgttaagtgggtttcagcattacaacgctgctgctggcaacagcagtgggagtcgatcttattcttaatgaccgcgctaatatccggcacccacagcgcgagggtttcagggctgaaggagagggtaatgctctcgaatcggccacaataggaggcgctgccgcgacagtctggcgtatgggtaatgtaatggcgattgcgcgcaagctcccagtcggtgtggcgccggagtccctgaatcgcaaagcgcgatgtgccttccaggatgcacgagaagttaatcctgcccagatcgtcgtgtagctgcaacgtctcaggccgcgcaaaatggcccctccagagcaaaatatccataccttcctgcaacgaacagcgcagcagttcacactgagcaggaatattgccatcgtttgcaggtttcccgaccaccaactggtgaatagagatttcagattgcgtttgcggtgactccgtcatgacctggttatctccctgtggcttagaccaatgcgggtataaatagaaccgaatggggtagatgagttattgataatggttattattcacattaattctcagaacgccaccctgaattgtcgtttttggcgtccgtaaaaattcatcaggaaattcagttactcccatgtcatctcaatcatccaatactgaatcgctgtcccgatttcctctctggcaggtgattacaccggttcgcaggaaggttattttagctatggcgctggcggggctggcggcattaaccagcctgggggcgctcctttttctggcgtggagcctgcgtgacattcgcgcgacgcctgacgctattccggcctggccgctgggcggcgtgatcggctgcgtggtcttaacttttgttctgcgcttacaggcgttcaacacctctcattacgcggcttttcatctggagaacattctgcgcagcaggttagcccgtaaagcattgcagcttccgcctggcgtgttacagcaaatgggcagcgggtcagtggcgaaagtgatgctggatgacgtgaagtcgttacatatttttgtggccgacagcacgccgctctatgcccgcgcgatcatcatgccgctggcgacaatcgttatcttgttctggctggactggcggctggcaatcgcgacgctgggggtactggcgtttggatcggttgttctcgtgctcgcccgccagcgttcggaagatatggctcagcgttatcataaggcgcgcgagcaggttagcgcggcggttattgagttcgtgcaggccatgcccgtggtgagaacgtttgatagcggcagcaccagttttttgcgctatcaacgcgcccttgaagagtgggtcgatgtgctcaaaacctggtatcgcaaagccggtttttcagcgcgtttttccttctcgactctgaatcctctcccgaccctgtttgtcctgatctggtcgggatacggcctgttgcactatggcagtttcgattttatcgcgtgggtggccgttttactgctgggcagcggaatggccgaagccgtaatgccaatgatgatgctcaataacctggtcgcgcaaacgcgtttaagcattcagcgtatttatcaggttctcgcgatgccggagttatcgctgccgcagtctgaccagcagccgcaagaggcgagcattacctttgagcaggtgagctttcattatccgcaagcgcgtactggcgccgcgttgcaggaggtgagctttcatgtgcctgccgggcaaattgtggcgctggttgggccaagcggcgccggaaaaagcaccgtggcgcgcttgctgctgcgttacgccgacccggacaaaggccatatccgtattggcggcgtggatctgcgtgatatgcagacggacaccctgatgaagcaactctcgtttgtgtttcaggacaacttcctttttgccgacacgatagccaataacattcgtctgggcgcgccggatacgccgctggaggcggtaatagcggcggccagagtggcgcaggcccatgattttattagcgctctgccagaaggttacaacacacgagtcggggaacgtggggtatttctctccggcggccagcggcagcgcattactatcgcccgggcgcttttgcaggatcgccccatcctggtgctcgatgaggcgacggcgtttgctgacccggaaaacgaagcggcgcttatcaaggcgctcgcggcggccatgcgtggccggacggtcatcatggtcgcgcatcgtctctcaatggtgactcaggccgatgtgatattgctgttttccgacggacagctcagggaaatggggaaccatacgcaactgttggcgcagggcggcctgtatcaacggctctggcaacactatcagcaggcgcagcattgggtgccgggtggaacacaggaagaggtggtggaaaatgaaagacaataatcctgcggataacctggcctggcgcgtcatctggcgccagcttatctccagcgttggcagtcaggccaggatgctgcgacgcagtatgctggcgctgttgctggcggcattcatgcaggggatcgcctttgcctgtctttatccgatcattgatgcgctgttacggggagacgcgccgcaacttcttaactgggctatggccttcagcgtcgccgcaattgtgacgctggtgctacgctggtatggcctgggctttgaataccgtggtcatctggcgcaggccacccatgagttgcgcctgcgacttggcgagcagttacgccgcgtgccgctggagaagctccagcgcggcagggcgggtgaaatgaacgccttgctgctgggcagcgtggatgaaaacctcaattatgttattgcgatagccaatattttgctgctcaccattgtcacgccgctgacggcgtcgctggcgacattgtggatagactggcggctggggctggtgatgttgctgatcttccctctgctggtgccgttttattactggcgccgcccggcgatgcggcgacaaatgcagacgctgggggaagcgcaccagcgtctgagcggcgatatcgttgaatttgctcaggggatgatggtattgcgcacctgcggcagcgatgccgataaaagccgggcgctgctggcgcatttcaatgcgctggaaaacttacagacccgcactcaccgtcagggcgctggcgcgacgatgctgatcgccagcgtcgtggagttgggcctacaggtggtggtgttatccgggatcgtctgggtagtgacgggcactctgaacctcgcctttttgattgccgccgtcgcgatgattatgcgcttcgcagaaccgatggcgatgtttatcagctacacctcggttgtggaactgatcgccagcgccctgcaacggattgagcggtttatggcgatagcaccgcttcccgtcgcagagcaaagcgagatgccggaacgttacgatatccgctttgacaacgtcagctatcgctacgaagaaggcgacggccacgcgcttaatcatgtttctttgacgttcccggcagccagtatgagcgcgctggtgggtgcctccggcgcaggcaaaactacggtcaccaaactgttaatgcgctatgccgatccgcagcaagggcagatttctattggcggcgtcgatattcgccgcctgacgccggaacagctcaatagcctgatttctgttgttttccaggatgtctggctgtttgatgacacgctgctggcgaatatccgtatcgcgcgcccacaggcgacgcggcaggaggtagaagaggccgcccgcgcggcgcagtgccttgagtttatttcccgtcttccgcaaggctggctgacgccaatgggagagatgggcggccagctatcgggcggcgagcgccagcggatttccattgccagagcgttattgaaaaacgcgccggtcgtcattctcgatgaaccgactgccgcgctggatattgaaagcgagctggcggtgcaaaaagcgatcgataacctggttcacaaccggacggtgattatcatcgctcaccgtttatccaccatcgccggggccggaaacattctggtgatggaagagggacaggtggttgagcagggtactcatgcgcaattgctctcacatcatggacgttatcaggcgctgtggcaggcgcaaatggccgcgcgcgtgtggcgcgacgacggggtttccgcgtctggagagtgggtgcatgagtgatgttcagtcgaatgtgaaaccgctgacgttgacgaccgggcgggtgatttttgctattgccggcgtctatgtgacgcagagtctggtatcggcgctgtctatgcagtccttacccgcgctggtgcgcgctgctggcggttcgctggcgcttgccggtgcgacaaccctgtttatgctgccctgggcgctgaagtttatttgggcgccgtggatcgagcgctggcggcttccgcccggtagccaggaacgccgttcccgcatgttaatcctgcgtggtcaggtcgcgctagcggcgatcctgactattgccgcagcgattggctggtttgggcgagaagggggattccccgatacgcaaatcgtcgcgttatttgttctgtttatggtggcaggcacggtcgcctccaccattgatatcgccagcgacggcttttgcgtcgatcaactgacccgcacgggttacggctggggaaacagcgtgcaggtcggcggcagctatctgggaatgatgtgcggcggcggggtgttcctgatgctgtcggcggcatccggctggcctgtcgccatgctgatgatggcggtgctgattatggcgctgtcactcccgctgtggcgcattacggagccgacgcgaacagcgactatcccgcatgttccggcgttaggttatgcgctaaggaggaagcaggcgcgcctgggcttactgctggtattgatgctgaattcaggcatgcggtttgtgctgcctcttctggcaccgctgttgttggatcatgggttgagcatgtccgcattgggcgcgctgttcagcggcggcaatattgcagcgggcatagcaggaacgctggccggcggattgctgatgaaatacacctcacccggcagagcgctgttgacggcttatggcgtccaggggatcgcgctgctggcggtggtgatgacgctcatgatggcgccgggtcatctgctgctgccgattctccagtgtctggtcattgtccagtccatttcgctggcctgcgcgctggtctgtctttacgccacgctgatgtcgctttcatcgcctttgcaggccggtgtcgacttcaccctctttcaatgtactgacgcggcaatcgccattctggcaggcgttatcggtggcgttgttgctcaacattttggctatgcggcctgcttcctgtttgccggggcattcacgttgctggcggcgtgggttgcttatatccggctgcattcggcaagagaactgatgacaagcgcaattgattgatccgggaataacacagagaggtaagggatgaaaatcagtgaatttctacatctggcgttaccagaggaacaatggctaccgacgatttctggcgttttacgccagttcgcagaagaagagtgttatgtctatgagcgtcaaccctgttggtatttaggcaaagggtgccaggcacggctgcacattaatgccgacggaacgcaggcgacatttattgatgatgccggggagcaaaaatgggcggtggattccattgccgactgcgcgcgtcgttttatggcgcatcctcaggtgaaaggacgtcgggtatatggacaggttgggttcaactttgcggcgcatgcgcgggggattgcctttaacgccggggagtggccgctgctgacgttaaccgttccccgtgaagaacttatttttgaaaagggaaatgtcaccgtttatgcggactccgccgacgggtgccgacgtttgtgcgagtgggtaaaagaggccggtacaacgacgcagaacgcaccactggcggtggataccgccctcaatggtgaggcatataaacaacaggttgcgcgcgccgttgcggagatccgccgtggcgagtatgtcaaagtgattgtctcgcgcgccattcccctgccatcgcggattgatatgcccgccacgctgttatacgggcggcaggcaaacacacctgtgcgctcgtttatgttccgtcaggaaggacgcgaagcgctgggctttagcccggaactggtgatgtcagtgacgggcaataaagtggtcactgaaccgcttgcgggcacccgcgatcgcatgggaaacccggagcataataaggcgaaagaggcagaactgctgcacgacagtaaagaggtgcttgagcatatcctttctgtcaaagaagctattgctgaactggaggccgtttgccagccgggcagcgtggtggttgaagatttaatgtcggttcgccagcgcggcagcgttcagcatctggggtctggcgtgagcggtcagcttgcggaaaacaaggatgcctgggatgcgtttaccgtgctgtttccgtcgattaccgcctcaggtatccctaaaaatgctgctctgaacgcgattatgcaaattgagaagacgccgcgagagctttattccggcgcaatcctgctgctggacgatacgcgctttgatgcggcgctagttctgcgttccgtatttcaggatagccagcgctgctggatacaggcgggggcgggaatcatcgcgcaatctacgccggaacgcgaactgacagaaacccgggagaaattagcgagcattgcgccctatttaatggtgtaggagtaactgttttctaacctcacaaccagactgtccaaagacaattgagtcgctctttgattcctctgtgactctattgtcttcttttgggataaaataggtgtttttcgtcatgaagttgataaaagtctatatagaaccacctcctgtggaggtggtggtaatttgccagagtgtgggattcgttagtatactatgggataaacttatttttaccaattgtataaggcggtgcataagattctcggcatgcttccagataatccgaccaccactgcatcatcgctttgcgggcttctaggtgctctgccttatgaatataagccatgcgcacggtattgcgctcctgatgactcatctggcgttctactgcgtcctttgcccataaacccgattccatcagcgcactgcatgccattgcccggaagccgtgaccgcagatatcctttttcgtgtcgtaacccatcacccgcagtgccttattgaccgtgttttcacacattggcttatacgggttatggtcgccggggaagatcagttcattattaccggtgatatccttaatctgtttcagaatggcgatggactgttctgagagggggacgatatgcggcattcgcatttttgccccgcggccggaataacgcacgccaataatgggttctcgcgtcgcgggtatcgtccagactcggtttgtgaaatcaatctctgaccagcgggcgaaacgcagttcactggagcgaatgaacacatgcagcatcagcagaacggcatgccgggtcagttcacggccctgatgatatgccccaatacgttcaagcagttcaggcagccgctccagcggcagggcagtgccgtctgacaggaggtgtggtcacgccgccaaggtttgctgcagggttcgtatcgattaactcctgatggaccgcatggcgcattatgttactcaggtgctgccgtgtgcgggacgcaacctccagcagacctttttcctcgatccctttcagcaggtcaatgaaatgacggggtttaagttctgatacaggtaggttcccgatgaccggaaagatgtgattgttcaggctggcaagcagacggtcggcggtgttctgcgaccatttcctgttacttttatgccacgccagcgccacgtttttaaaaactttctccggtgttcgtgagccacgttcagcagcccgctgctgtaccgggttgatattcagcgccagcattttacggataccttcacgttgctgtcgcgcatcagacagggagatggctggataggcacccagcgcaatgcgggattctttaccgctaatacggtatttgagataccagtggcgggagccacccggcttgaccagcagatacagaccgtgagaatcggagactttaaagggtttatcagaaggcttgagggtgcggatttttgcgtcggtaagggacatatgggggtcactccattatcgaactaacctgaccccagatttgaccaccaatttttcccgatgcgtagggtaaaatcaaaatgcaccgagaagagttttcacactaacctgttgaatcaacatcagataaagattcgcaaggatgcatgaaaacagaaaattggctcctctgactggactcgaaccagtgacatacggattaacagtccgccgttctaccgactgaactacagaggaatcgtgtgaacggggcgaataatagcggggacagagggacatgtcaaagaagaaaagataaattcggatcgtttgcttacaagttgggcaacttgttgagatttttagcttttaggctaaaacttcgtcaaaattgtaggcaataaaagcaatagctggcgctgacagtaaagcgtgtagtggtgcctaaagtgtagtatcagccaggccagtagcaaactcagcgcagggaagagcaaaccacggtgttgacctgtaactgttcgttatgtagcagcccatacaccgagttcggttagcaaaagtatcggccaataacggcgaggtaacagaatcctcagcgcctaaataccgtcttgccaactatcggcaagcggtatttaggccgcaaatggttttcccgacttcaatacgccataagccaactgaccgcaattacgccatatcagttacccgccagtagctgatgctgtagtgcgaagtgcaccagttcaatggtggtttcacaattgagtttactcagaatattggcccgatggacatgaacggttttatggctgagcgacaactgttcggcaagggcttttacacttatccctttgaccaataattgaaaaatctctttttctcgcggagttaaaattgtcagcttactcggctgttgaggcatttggcgtagcgcccgtagcgcatcggtacacagataaaggccgccgccattgacggtgcgcagtgcctgtaccaatgccgctggatcacagcgtttggtcaggtagccactggctccggcgtccattgcactctgcacaaaggcggttgtgtcataaatactcagaataatggcgcgaaaatgcggtatctgttggcgcaggcgcttgagcaggcttagcccgctctcatccggcattgaaatatctattaccgccacatgtacatccgttttgggcagattttcccatgcctcggccgcacaaccgtattcgccaataatacgtatatcttcttccagtgacagtaattgagcaaaaccagaacggacgacaatatggtcgtcaatcaatgcaacattaatcatgatttctaattattgggggagagaaacagcatgatgctcatctctttatcgcggagcaatggttgttatcaaaaatataatgggcttagcatctatgggatacaatagcttaaaaagtagtcagggagacaggttgtgggaagaaatacctgttacaaaaagaaataaatgttgcgaaatgtgtagtacagattgaaaccgtgattcagataataatgaaccgggctaatcagacacccggttccttaaccctccccttaaccgttatatattccaaacatccgtggcaaccacagagagatttccggaatataggtcaccagcatcagcacaaagaataacgcaccgtagaagggcaacatggcttttaccacttgctctatcttttgtttactcaccgcactggcaacgaataagaccgatcccactggcggcgtaatcaggccaattcccagattaatcaacataatcataccgaaatggaccgggtcaatacccaacgaattggttaccggcattaataccggtgtgaggatcaaaatcagcggtgccatatccatcagcgtaccaatcagcagcagcataatgttgatgcacatcagaatgacgtatttattatcagaaatagaggtaaagaaatcagtgatacgttccggtaattgcatgtaggtcatgatggcaccgaaactggcggcaaaccctatcaggatcatgacaatagtgacggttttgaccgtccgatacatcagtttgggcagttcggaccacttataatcacggtagacaaacatggtgacgaagaatgaccataagcaggcgatagccgcggactcagtcgcggtaaacacccctgacaggataccgcccatgatgataacaaccgtcatcagcccccatagcgtatcgacaaaaattttaagtgcctgacggaatggcacccgctcacctttgggataaccccgcttataggcgaagccgacacacatgagcatcaaggtcaggctaagtaacaggcctggaacgatccccgcaatgaacagggcggagatggagaccgtcccaccggttgccagtgaatagatcaccgagttatggctgggtggcgtcaatattgcctgtactgaaccactggcggtcacggcagcggcaaaatcgcgagggtagccttttttatccatctcagggatcatcactgagccgatagaggcggtatcggccaccgaagagccggaaatagcaccaaaaaatgttgaggcgacaatattcaccaatgacaggccaccgcggataaagcccacgaagatataggcaaagttgaccagccgtcgtgcaataccgccctccgccataatggcacccgccagaataaagaagggaatagccagtagggaaaatttattgaccccactggttatttggatcatcacggcttccagtggcaaatcaatccaaaacgcgccggcaatggcactgaggcccacggcataggcaacggggacaccaatagccaatagaattgccagggtaaaaactaaaataaatgcgtccataaggcagagttccccaaaattatgaattgccgatcatcactaccgggcgctgggtttgcgggccaaaaaataggcgctcgataataaacatcagggtaatagcagaaccgacaggtaaaggaagataggtttgtccggcggtcaataatgggaactcggcgacgggttgcgaccataattcgctgcacagaatatagctgtagctcagaataaatagacttatcatcaccatcagcaaattaaccagcaacgcacagatcttcttacccgcctcgggaattctatcggttaccatgctcacggcaatatgagaaccagagcgataactggccgctgcgccaataaaggtgaacgtcaccatacataaaatagcgacgggttctggccaagataagccgtcgttttgaatataacgggcaaatataccgatagggatagcggcaaccataataattaaagcgataccggctacccagattgataggcggtataaaacatccatcgcagagagataataacgagccatagtggaaacctcagtatccctttgtccttggcgttgcagtggcgttagcagccttattgcaacggcaatggcgttgggtaatatcagcggtattaaaaataattcaataccgccggatggatgttattggacgtcaccaatctgtttaatcaagtcctcatgacctttgccgaactcatcgcgtacgggctgagtggctttataataataatcacgatcaatctcatgatactgcacaccgccggccttcattttctcatgagcttgttgctcataggctgtccataatacgcgttgctcagcttgtgcttcttttgctaatttaagaatggtttgctgatcttcggcagataatttgtcccacttggctttcgaatacaggaatacttcgggaataatgaaatggccgctcagggtataatttttgacaacaggcaggtaattatgggctacaaatgtaggctggttattttcggtgccatcaatgaccccggtttgcataccgctgaacacttcactgacgcccatactcagggcattggcccccattgattttagcgttgctaacgcaatcgggctgccttgaacacggattttcatcccgctgagatcttccggtttaatcaccggttgtttagtaatcaggtgacgggtaccgccatccatccaacctaagaacaccaattttgaatttttgttatcggtgattttaccgcctatttcctgaccaattttaccatcaaggaccttatgtaaatgatcttcgtcacggaagatatagggaagggtaaagacattaatctccggtaaaatagaggcaacgggtgtcatagaaacacgaataatatcgattgcgcccatttgcgcctgttctatcatttgcttctcatcacctaacactccaccaggaaatgttttcatctccagacggccatcagtcgcgactttcagtttttcgcccatatcttttatcgccacgacattgggataatctttaggatgaacatcggctgctttaatttgttgggcagctacggattggctaaatagcacttggctaagtaacaacgccgaggcggttaaacataatgtagggaaagacgttggcaatctcattcaatgatctccagaggtagaatacccttcatatttgacgttgcagcggtgttatcggctctcttctgaaccacttacctaagtgaactcagcgggttccgtgtatttgtcaccttgctacggtcaactgctatagtcaccttgctacagtcagcgtgctacagtcagcttgctacaacagcaatgacttcgggcataacgtatataagtaaaagaggttgttttaataattaaagggaaatctcagtatatataatagggatatatccttatcccgatagcgaacaagctagctgtttatattgggttttaaattgatgatggtcacagaaaaagaaatgacagaaactgcgtttcaataattgtgaagtatcatttcaccgcaaggtcagaaaaacagatcctcctccagtccacaaccgaaagttgcggcattttcccgtatccgggtgcttgagattgttatgttcggggttagcaactacgataacagtctatggattaagataattagggtaacgcgtgacgtcggtattcatccgtaattttacttttgctgcactgccagccaacggcctcaatggtcaacccccgtttcacgggcttttggccaagtgtgattttgaggtgaatgaatatcgggacgagttgtttgcagcctatggcattccgtttcctgggagtctgaacaaggcggtgatcaaacgtcgtgccgaatacctggctgggcgttttgtggctcggcaggtgttgaacttattggatatccgcgattatccgctagcgacgggaatggatcgtgcgccgcagtggccaaccaacctgattggcagtattagccataataaccaacgtgcgttatgtgccgcccaaatgatagagccaaggggcgttgagtcttctactttgcatggcataggtttggatattgaaagccatatcgctgaggaaaaagcgcaagagatttggccgggtattatcagcgatgaggagtattcgctattacaacaaggcccattgccctttaaccaagcactgacattggttttttcggctaaagaaagtttatttaaagcggtctatccccaatctggccgctatttcgattttatcgaagcacgtctgctgagttactcattggtgtcaggcaattttgaattgcagctattacgacatttaaatgatgaatttcccgctggccgttgttttagtggctgttttagtctcagtgagacggatcttcagacctttattgcttattaaaaccaagaattatttatctgagaataaggggctgaatatgaaagaagtcttaaccatcagcgtgttggaaaaatcgttaaaggacatcactcgttatgcagttaataaaaacgatatgcagttaataaaagcaatatgcagttaataaaaacaatatgcagttaataaaaataatctagctaatatatgattcattgtcatggtgttcttcggcattcgctcaataattaaacctttctttacgattaagttgtggtgatttgcagcaatatctccgtcaattgattttcgcgcgtatttccatttttctgccattcgaactgttttgggtataacccaaatagataagtgcggtcttgctcaacaacgtgaagaccaaatagccattggacgtaaagtaggccgccataaacggcggcctgaggttaatttacggctgaaagctgtatcaggatagccgattcaggattgaggatgggaagggcaattcctgctttctctagccaatcgccactgacgacgagcgggcttttcaaccaggctggatagcgcttcatggtgttatttcgtggtttgtgcatgctgtcaggcatgtccagaacctcgatctgatagtgtgtggatgggttaagaccaggaatcaatacgttgccacataaggcatattccggtagtgctagctggctgatcaggacgacagcttgctgctggtcgtgtgcgataacggcattaattaatgttgttttatccggatggtcgagccggatcgtgtttccgctatgtaacagcggccgcagttgtttatgtagcgcaatataacgggcaaaagcctgttgctcggcaggagattcactcaccggatcaagctcgacccccatatggccgaacagcgctgtcagcccccgaaaattaatagagtgcattctggcggtggtatggcacggagtaccgccaatatgcgcgcccataacttctggagggaagaagtagctcatccctcgctggatctgctggcgatcaagagcgtcattgctgtctgatggccagaaacggtggcagcgttgcagaatttcataatcaatacgccccccgcctgacgcgcaggattcaaattcaatatgtgggaaatgcaggttgagttggtcgaataagcgatacagttgctcggtctgttgtaccaacgaagggtggccgcggtgaccgggctggaccatctcgcggttgaaatcccatttaacatagtcaactttgtgttcgcccaacaaccagctcaagcgttctagcaggtagtcgaaaacggccgggttcgataaatcgagcaacagttggtcgcgtcctttcagtagcgggtagccgtcaagtttcagcacccagtcaggatgattacggtataaatcagaatcctgattgatcatttcaggttccacccagataccaaactccataccgtattcattcacggcttcaataatggggttcagtccctgtgggtatttttcggcatcaatataccaatcgcccagtgaacttaaatcgttgttgcgtcctttgaaccagccatcatcaatgataaagcgctccacaccaattttggccgcgtttttcaccatctgaataatgtagtctgggtcatgcttaaaatagatgccttcccaggtattgaggtgcaccgggcgcggtttttctgccagtgatggcacgatattctggcgcacatagtgatgaaaactgtggctcataccgttcaacccggtagcggaataggtcgcgtagacccacggggtactgacactctgcaagtgttccagaacgatttcaccggaaaaatagagggcttcggcctgcacctgacggcggccatcacttttacagtcagcgcgtaaacgatggtttccactccaggccagatgcaagccccagacctcgccctgttgctcactgaagcctgctttccctactaccatgccgggaaaatattcatgtgaggttctgccgcgccgattttcctgaatataaccgccatgatcgagtttaagtgagtggcgctggaactctttaatccaacggccattgaaggccatgatttcattggcacgttccggaaaaggcaaggtcacggccaaccgatcgattcggtagcatccggctttaatattggtcagcgtattgcgggtttttatcacgccactgtctgggcacatctgcaactcactcaccagccgcaagcccgcgctcgtatcttcgctaataatcgttaataaattgttttcaagtgtatggctctggctggtgaaaatgggagaccaatcttcgccatcacggtttccctccataccgggcacgctgaacagccctcggccattttcagggcagagcgtcaacggtatatcgctgtccaggcggctgttagcgaccgggcggtttaaggcttccatcatcgcaggcgagtaatcaagcagaggcttaccccagtaaacaatttctgcgtagggagagcagcgcacgatcatgtcagaagaacggctggataatctgacaaaggtagtattcataatggctcctgtgaaaacgaaaatttgctcgaggtgatggcatggcggcgacaccctcgttatctgtattgaattttttaagattgtggctgagaaactggaggggtaaccgacggatcctcttttagccttgacgccaggtttgctaccgcgctgcgcccagagagcgtgaaagctgaaatgagggtaaatgacaggacgataacgcctaataccatgtacgtgtcttgatatcccatgctgtcatacatgcggccagcaaatactgacataaacatcatggataactgtttgctgaaacagaacccaatcagatacaccgttgctgaaaaacgaacttcaaatacttgagtaatatatttaaaggagcctaccagtaagaaaggaacctcaaacatatgcaacattttcaggaacaccacttgggtcgctgtcgtggcaaatgctgaacctaaaatacggactgacataatggtacctgccagcaataacgcatttttgctaccaatacgcgcaataattaccggagcgaaaaacatcacggttgcattcagaatttcaccaccggtagtgacaaaaccgaatatttcagttccttgttgtttggtggcaaagaatgaagtgaaaaagttagcaaattgctgatcaaacacatcataaatacaggcgacgccaacaatatacataacgaagaaccacaactcccgtttccggaggagtgccagcgcgttctttaagttaaataccgctttattcgcgcctagagtatcgacaacaaaggccgtagattgtcggtcggggcgagcgaagaacagcaagacagccagtattaaggcgcagcctgatgccatccaaaaaattaattggttgttgacggtgtagagtattccaaccacggtggcgcacagtgcccagccaatacagccgaacattcttacccggccgtattcaaaattactgtggcgactgaccttttcaatataggcttcaatggcatgggaaccgccagtaaatacaaagcccaaatagcagccacccacaatagcgccaatgaagatgttatatttcagtaatgggctgaaaacataaataaagaacggggcaaacaggaccagtaatccaacaatgatccacattagggttttgcgtaatccaagcttgtcagagagcggccccataattggctgaaaggcgagggcaaaaagtgaaatgctaccgaatacaataccggtgtctgttttgctcaggttattaatatcatgcagccagatcggaaagaacgggtagtacgatgccatgataaaaaagtagaagaagaaaaataacccgaacaaccagaagttattatttcttaaataggattgtactgcgtttgctttactcataaacccctaacctctcattagctgaaacgccagagcattgctgctacatgctcgcctttttttgtacgatcttgtcgcgatggctgccagcgttattcagtattcgccgcttgttatcgctaaggtccggcattagagtagatccgaaacgtttcggatttaaatctaaacgtttcggatgtgtgacgaacttaaaactttacgtatgatttactcgggtctcagggggtttttggtaaagttgtgaggtgagaacaacggacgtataacctgatttatgtgtagcttacttgggaaccaatacaggttaaatcatgctcaatttaaggtcgttgacctgcggatcaaaaaatcatgtcattgaagaaaattgcaaatgagcttgggctgtcctccacaacggtaagccgcgcgttaaatggctatgatgatgttgcggccgaaacacgtgagcggattatcgatgcggccaagagattgggttatcaaccgaattccttagctcggcggcttaaaatggggagaaccgatgccattgctttggcgtatccatcacgtccacgagtgttgaataattcgacatttttggaaatgataagttggataggtatcgaactcggaaaacggggtctcgatctgttgctcattcctgatgaacctggtgagaaataccagtcacttatccacttggtggaaacgcgtagagtggatgcattgatcgtggctcatacccagcctgaagactttcggttgcagtatttgcagaaacaaaactttccttttttggcattggggcgtagccatttacccaagccatatgcatggtttgattttgataatcacgctggcgcttcgttggcagtgaagcggcttctcgaacttgggcaccagagaattgcatttgtgagtaccgatgcaaggatttcatatgtcgatcagcgtttgcagggatatgtgcagacgatgtccgaagcgggcctgatgccgttggcagggtatctgcaaaaagcggatcccactcgtcctggcggttatcttgctgcctcgcgtttattggcgcttgaggttcctcctactgccattatcaccgactgtaatatgctgggtgatggcgtggcgagtgcgcttgataaagcgggcttgttgggcggcgaggggatatcgcttatcgcttatgatgggctaccggatgatagtttgttagatattgccgtgacccctattgttcaaaatacgcgtaccagtgtaggtaaacaaattgcatcaatgatttgtgatttactgggggggaaggatcctaaagaactacaggtcctctggcagccagaaataggagagggtgaaaccgacggggtgaatcgacgtggataactggctatttgggtcgggtcgggtcgggaaagggaagggagaggaagggtgctgttgagccgctgagactagacgtagataagcgaggagagtaactcagtgatagaaaagcaaaaatcccgcttagtttcctaaacgggattttctaaatttggctcctctgactggactcgaaccagtgacatacggattaacagtccgccgttctaccgactgaactacagaggaatcgtgtgaacggggcgcatcatatccagcatacccgatactgtcaatgttaaattagcacattatgtttaactgctcagcatctgaacaaatagagggtaaatcgcaacaacgtagcgccagcccaaggtttttatgattaacgcatattttgaggtgtggagaataagctaatcgctaacggtgcgagtgagtattctcgggaggcggattgtctgccagcgagttttcccagcgttttagtcgagctaatggatcttgacggtagaaccggcaaaaatgttgatagactgccgggaaacggccctccagcagctctggggcactgaaaaagtattctgataatacggcaaaacattctgctggattgctggctgcataggcatccatactggcaccttccacacccaccatatcaatctcgtcttggatattatccatggcgtggtgtagatcatgctcccataccgccacatcacgcatcgcaatggggggcacgccatttgaatgacccccattacgcatatccaatttatgggcagcttcatggatcaccagattaaagccagataaatcgaatgaatcttgaatatcttgccagttcaggacgataggtccttgttcccagctctggccagactgtacgctttggcctgaatgaaccaacccaaggtcatcttgccagtcctccgcgacaataaagggagaagggtaaataaggacttcgtgaaagccatctaaccatttggcacctagctccataaccggcagtgcgaatagcaaagcgaggcgtgcttgcatcaatggggttaatatcaagccttgtagggggatgaagcgcttttgttgtaataattgactggccaccgaaaccaaccgttgctgttctggttcgtttaatggagccagcaaaggaatattcagtgcctcatgccattgcgcaagcatctccgcttgcggtttatttgctttccacagccatttaatcatcaggttgctcgcaaagtgatcattctaacgtctaaagcaggggagtattgtagtcaacatgccgtaaaagtagacatgatggcaactgttattatggagaagactggaatcattgaacggggtggtttggaaaaccgcggagagggaattcctccaaggattcacattcctctctacctaattattcaatcagttacggaataaaatgtctgtgaccggccccgcacttaaattacgcctaggaagattttagcttttaagtggctgaatgatttcgttttgtgatgaccacatgcattaaaagagagaacagtacgtttccctcaatctgaacttatcagcagccatggcattcaccatggcttatggtgtgcttgacacattctacatcacagtgacttcagtgcttcgaccgactcgatagccattgaaggaacaaattctgtcacgctgtaatctgccacagcattaaacggatcttctgccaatattttatccaacgcttcacgcgcaatacttttcactaaaataatgccgccggtacgtggtactttccggccggaggcgataaagacgccttgcgcataatattttttcaaccagtctttgtggttctcggtgagtgcttcgacgacgtcgataggttgatggtaggtcaagctaacaataaacatgcacaactccttcacggtgggggatactcaagataacgccttagtgcgtggttggcatccttaacataataaatgcttggtcgttctttcaagtctcggtgatggtctgtctctgtagtcgatagccaacggagatattatcagagatggggaggaggagcagggaaggccgctgctccagaggttgttttttgatcttcttagagggcttgatttatctagagggtctactttatttagttgttgtgctcttgagcctcgcgcagacgttcttgctcttcggcaataacagctttaatttcatctaatacagcgtcgacatccgctgcctgagtgctttctgcaaagttcccggtgagaggcgtatctggatgaagtttaccgtcttcataaagcgcccacatttccttggcatacttgcgattcagtaactcgggggcatattgaccataatagtgggtcatattggcaacatcccgctcaagcatggctttagcatggttattggcggccgcattaaccgcctgcggcagatcgataataaccgggccatctttatccattaacacattaaattctgaaagatcaccgtgtaccagacctgcgcataacatccgcaccacgtattggatcatgatttcatggtcagccaaggcctgctctttagataacggcacgtcactgagtctgggtgccgcgaggccatcttcatcagtgaccagttccatcagtaaaacgccatcaagacaggtgtaaggctgtggaacgcgcactccggcattagctaacaggaacaacgcatccacctcggcagtttgccaggtttcctcttgctgtttgcggccaaatttagagcctttagccattgcccgggcatcacggctattacggaccttacgcccttcttgatattgaaccgcttgtttgaaactgcggttctctgcttctttataaactttagcgcagcgtatgtctgacccgcaacggacaacatacacatcagcttctttgccacttttcaaacgacggatgacttcgtcaaccaagccgtcatcaaccagcggttggattcgttttggaattttcatggcgtccttgtaccctatttaagccctcgatggaatggcttcggccgaatttttcttcagtttaccacccggagtcgttaacgggtgggtttttactgagtatcaggccgcactaaactgagcatggtgtaatattgcgtaggcaccttgacgtgccagtaactcgtgatgatccccttgttcaataatccctcctttatcgaccacaataatacgatcagcattttgaattgtggctaagcggtgtgcaatgaccagtgtggttctgccttgagataattctgttagcgccaattgaatcgcttgctcggtagcggtatccagcgctgatgtagcctcatccaaaatcagaatcggggggttcttcagaaaaatacgcgcaatggatagacgctgtttttgtccgccagataatttcaccccacgttcaccgacgagagtatctagcccttcgggcagagaactgattaattcatccaaacgtgcccgttgtgcggcaaccataatttcgtcatcgctggcattcagcttaccgtaggcaatattctctcggatagatccgccgaataagaagacatcctgctgaacaataccaatattgttgcgtaaagactgctgtgtcatctctcggatatcaatcccatcaatagtgatagcacctgcattcagctcatagaatcgagggagcaatgagcacaacgtggttttacccgccccagatggcccgacgaacgcgacggtttcacccgcatgaatttgcagatttaaatcagtgaaaatgggcgcttgggacgaataaccaaagcaaacatgttggtagctgatatccccacggaggtgaccaaccggacgcgcattcggttgatcgacaatatcaggtaatgtatcaatcaactgggtgaatcgcttaaagccagcaattcctttagggtaactttccagtactgaagttattttctctacagggcggaagaatacttcgactaagagcagaaaaccgacaaagccgccgtagctcagttggtcgtgaattacataccaggtgccaacgaccatcacgatcaattgcaccaaacgggtgctgagatagctcatggtcatgctggtggtcattatccgataggctcgtagcttggtcgtccggtagttttcgttatctttggcaaagagtttctcttcgtggggttcattcgcaaaggcttttaccacgcgaataccaccaatgctctcttcgatacgggtattaaaattacccacctggccaaacagtttgcgccaggtatccgtcatttttgaaccatagcgggtaaccagataggtcataaacggcacaatgatgatagtgaccatcgccagtggtaaatgaacggtggccatcaagataaaggcaccaataaaggtcatgacggcaatgaaaaggtcttctggaccgtggtgggcaacctcgccgacttcttccagatctttggtgacatgcgtgatgatatgacctgtttttatattgtcataatagctaaatgacagtttttgtaagtgattgaatgcttgacggcgcatgtctgtttcgataccgacaccgagcgcatgaccccaataattgacaatggccatcagtactgtattcagtagataaatcagtagtagcccagccgctgcccatacgatcatcacccagtcctgattgggaagcagtttatcgataaacagctttaccgccattgggaagctgagttctaagagcccggctagaattgcgcaaccaaaatctaggaagaaaagccctttatacggggcgtaataagagaaaaaacggcggagcatcagacatccttattacagaagaaaaaaccggcacacatgtccgataaatcagtttgaagcattataaatacaaatggttcttaatagcatttattttacctatgctaataaatgaagaaaatcttatccacggaaataggcgttggatttggctaaatatcgaccagtgctcattatttaacctttggtgttggggcgctgtctgcccaaaaaaatcctctggttcgcggattcgaataagcggccatcacttcaaataagcgatatcgttaaaatacttaatttatattaatgtatttatccggtgcccttaactttacaatagatagacttgatctatagcgcagagtaagacaggatcatttttggatatcattccaggctgtcgttgataatacgatgcttagtaaaaagtatgtctactaaaaagcatgtccaataaaagacgcgactttttcatcaggatgatagctaatgtaggtatttatttgaaaaaacaacgaaatattactcgaaaaggtgattatgcaacgggaattgatgatgcgcaatttgcattagtggttttatttactgcatcatgtttgctgattgcaacgaccttgattgtaatcttgtggctaatatgatgggacgaagacattaaggaggatatgtggagacgagtttgtttgatgataataaagtcatcgcgttgattggtttactatcgacagcacttattgtggttagtgtgatgtttgttatgacatatatggcagatcatcagcgtaatgatgcacaacttattgatgtgcagaactgttataaagaggactgaagcgtgttattcaccgggtagctattttatgtattataggcaccttctgtattaccgatgaacagtgataacaagaagttatcaggcctgtttttggtgaatagcatgtaaaggtaatgcaatattaaggtcaatatctgtgttttgtctgaagtcatacggagtgatgccgtaatgctttctaaacatatacgtaaagtgtgattgtgaaccaaaaccaaaatctaaagcgatatcgaaaatagtgctatcactgctccttagctgataaacagcgcctgctaatcgcctctcccgtatgtacttacccagtgacacgccagtgacatctttaaatattttttgcatatgccaaagcgaataacctgagtatgcggctaactcttcaagatagatgacccgccctaggtgggtttcgacccatttactgagggcgcagactaacgcgagatgattttcttgtgacattatttagtctgttttttctggttgggagtgttgcagtatacacaagttgaatcgaacaacataaaacactgaactctcctggattatacccaatgtgcggtaaagactttttggccgaggtttggcaaaagagttttcaagtgccatagtaaagggtgagtgccatcatgtatccatggagaaaaggctgagtttggagaaatagagattaagaatgatgaggtgatcgcatgttgatagcagtgattatgactctgatagcggttgttggtgtaaccatttttttaaagatgccagtgatggtattgcataaaggtaagcgctcaggaggtgatgaactatgagattaggaatattgtgatcggtattcatacagtcgttttccccagaaccaggtaattgatagccatcaagcctggtttttttatgttgaatataaatgcgtcagtgccgcagtataatgcctccatgggatagcaatcgacagactaaagaaatttgcaaatagtcgtgatagtattattcaatattattactatctttaaggtttttctatgtctgaaatgttaactaatgaccaagaattagtctctgatctggtcgcttgccaactggtcatcaaacagattcttgatgttatcgatatcatcgcgcctaccgaagtgcgtgataaaatgtcgcatcaactcaagactatcgatttctcaacacatccagcgggggcagatccagtgaccaaaagagcaatcgagaaggctattgcactgattgatctgaaatttacacaaaaatagcgtgatcgataagaaaatatcacactgtgaagcatgatgaccacatggctgaaaagagagagaacttattttgctcaatcagttgatgaatcattcaaagacattgttgccgattttttttactaatgggcaactgctgatccctatgatgccgttctcaccatttatatattgagcgttggcgatatttctggcggttagatatttgcactgtaaacctaaaccagcggcgtttttttcactgccaatcagcacgccgtagccagaaaatagcagccctaggtatacgatcgcagccaccaaaaacaatctgaataaactcatgttatcgccccagagaataagttaaatcttttttaagaaaatagactgaacagtttaatttatgatgctgagttagtgaatggtaaaaatcctaaatgttggcatatcagtttaacacgccataccgccgtaacatgttgttgctggactattttccacacggacactttagttataaatggttgatgctggttacagtataatttaaaaaaaatgataaataagggtgctcgatttgaacataacgaaacttgtcacaacggttgtgatcattgccgcttgttgcttgttttatctattagctctcgatagttactgcgatcagggagggactttctcaacgggtatttgtgctattactacgattgttccctggtaaggggctaacgccatgatctgttatcaattaagcgcgcgcgtgacgaagacgcggcaacgctaagccaatgagcagcataagcacgcgtgactgcttgcgttgattttttaactatccgcacagtcctctttttctgattcacctttgttgtgggcggggtgataagatagtgccttcaccatgcatatgtaatagggttgtcaatgttggatacaaatatgggcgcgtttggtgtcgcctcaatcgcctcaatcgccttaccgctgcttaccgttcttttcttcttgatcgtttggttttttttgagccgggcgagcgtgcgggccaatgaacaggtccggttattacgagaaattgccgagcagcaaaaacgtcagacagaattacttactgcattactggagaatgccacgggtacccgtgacgggcagaacgacagtgatacggtttctcctctcgatttcaaaggctttattccagagcgataaacgtgtcccgatgctggcactaccaacaggcagtgtcagcatgttacctgcaattttgttggctacggcaaaggtaattgcatcataattagggggcctcttcttcacggctaacccgataccgccaatatcctctttccatcagcccttaaccaagataatcagttcttgtgcaaggtaaaagaaagccgctaggttgtcataaatctgtcttcttctcaccgtaatgtaatcagaacttttcaggtcaacgggggttcttatgattaaatggtatgaagaaagtgatagtgaagtgaaccgaagcattgcgctgcttaccggtgaagaccctgacaaatggtatccttacggtggtattaaaggtaaggactactgcaaaaatccctccgatgcatggcctatcatctatgccaataaaattggtctcttttaccctgaaactaatgacaataatcagtggaatgcccgtattaccaatcctcagggggaatggcaggcttatagccaaagcccgctacgcgcggcgatgatctgttatctactcagccaggaagtgtagtctgtcatggccgggaattctcagtaagtgtgaatttctcgcttgtatcgtactgacaggaagtcgctatcagtaagcgttcttcttactgttttcgtggagttgatgatgaagcgtattattaaaggcgacttaaatttatctcatctggttattgcccatgcggcaattgatcgccatcaaaagtcatacggagaacggcgtcagggctggccatccacttatcttgttcgctacaaaaataaccgtgttgccgttgaagttgtcacccgacgtcagtcgtatgtggcgacattgatgattggcgcgcgtaatttgagtaaattatgtggagtatcagcattattaccctaattatgatttatctattgggtagacaatatgatatttcatcaagtagtggtgcgcgttaaagcatatcgttgtgtgcgttaaatcacggaagtgtatgagtgtttgtacctcaaccatcaaacaagcctttatccttgatgctggcgggtttaagtgttaaaaaaaccgccgcagactcatttatgaaatgcgttgtttattcacaccagtgcgtaatcagtgcaacagagggtaggatggaacagcagttacagaactcatcgttaaaacgcggtttaaaaaatagacatattcaactaatagctttgggtggcgcaatcggaaccgggttatttctcgggattgcccaaaccatcaatatggccggcccctcagtaatattggggtatgcaataggcgggtttattgcttttctgattatgcgtcaattaggtgaaatggtcgtcgaagagcctgttgctggctcattcagccactttgcctataagtattggggcgattttgctggttttctatcgggctggaactactgggccatgtttattctggtcggtatggctgaattgactgcggtaggcatatatattcagtattggtggcctgagataccgacatgggtttcagcagcagtattctttatcataatcaacgctatcaacttagttaacgtacgactgtatggcgaaacggagttttggtttgccatcattaaagtggctgcaattatcggtatgattgtgttcggtgcttatctactggcatcgggatctggtgggccagccgcctcggtgacaaatctctgggcgcaggggggttttatgccccatggctttcgtggtttgatcatggcaatggcggttattatgttctcctttggcggtctggagatggtagggattactgcagcagaagccgaagatccacggaacagtattcctaaagcgactaatcaggtcgtttatcgtattcttattttttatattggctcactgacggtgcttctgtctcttttcccgtggaacaatgtcgtcgaagggggaagtcctttcgtgatgattttcgatgcgttagatagcccttgggtggcaacagcattgaatgtggttgtcctgaccgccgccctgtcggtgtataacagtggtgtgtattgtaacagtcgtatgctttttgggctggcatcacaggggaatgcgcctaagttgttgaccaagttaaataagcgtggtgtccccatccgttcaattgcactttcagcattagcgacttcagctggcgtggtgattaactatattatgcccggcaaagcctttgaattacttatggcgttggtggtttcaacactggtaatcaactgggtgatgatttgcctggcgcatctgaagtttcgcaaggctaaagttaaagagggcgttgtgcctcgcttcaaagcactctggtacccctacggcaattatctgtgcctggtcttcctcgcattaattctcgtcattatgtatctcaccgaagggattcggatctctgtgttgatgatgccagtatggatagcgttactttggtgtggttttgtacttactcggcgtaagtgtccaaaaacggtgactagcctctaatgcttcctgattagcagggcagtaaaatgccgcgcttggaagggtgcggcttgagcttatatcaatagtgattgtttgattattgtactttattgttattggacatcaggcagattatttttggtcgtttaaataaaaaagctataaataaatttatctaatgtatttattcaaaaaattgggggtgttacatctttatagttcattaacgcaactggaattcgccctcaaccaagcatataaccattttaatattatggttatatgctgttttttagttaaataatgtcgtcaattaaaattgccagcgaatccaggtaaacaacacattcccattattataagtgccgggaatataggtggtttgtagggagagtctattatattcaattgaaataagaggcaaaggtaacggaaggggaatataatgatattcatagcgtgcagtaatactggcagtaaaacccgccccaaaacgccacccctccctctcccctggtatccacatcttctgataaccatagcccagaatcggttcgactcgattgtgcgaatccataaaggccatcgcatagacagaatgccaattgttatcttcatcatagcggtacttaccgtaaccaaccccccatggtctctcgttgtatgaggctatcttttcatcatcataggtccaacggttatgccaggtattcaccgggatataaagctcctgatggggggagttccaggccaaagagacattgcgtatcaggcgctgccataggttaccttctgctgcgggttgaagggactcctgccccttggagacaccgacggagggggtatcagccaacgctgatggtgagtgcaaaagaaacacaccgctaagaatgcaggcgttgataatgtccttgtaattcataatgtctatctctaatgcagatgagggaaaataagatttttgagcatcaagcaatctatatacttaacaaagtgaaagttgaacaatggattgttggaaatttatcagagggagaaacctttaacttaaacagttctataacgaggggggaatataagattttaaactatcaaacagagtcgctaaagtatgaatcaggaattttgataaatatattacttttattttttacataaattagcagagaattggcttatgctttcccgttgttgagtgatgatcaatcggtgataatctgtatatttatgcaacatatcaggcctgctttagcacttctctggtgcagaatgcgaagggaggagtggattattgcactttttttgggcatggcgagaataaactaatagtcacgtgatgtttttggcggttcatatttaatttgatattttcccattcgcatttttttctttagcatacataaagagtgcgccagcgttccactcaggctgacactaataaatattctattattagatctgtcatgcgaataaaaattagcaatcataaagcaataacctgaggttaagtaaggggttagtcttggtacgttagcgtcgaaagggaaccctccatgcgtgatgagatactgtaaccggcaccgtgttatattcaattattatatatttaatgctaataaattttatacttaactggttttttgcttgactcagaggatggaaaccaaggggagggcaagtgatcgggattataaaaagagttagctaaaatgttaaaatccagtaaaactgggggatgagacagtataaaaaaatagagcagaaaatacgatgaccttcaacaaattttaacatattcacgcactctttatgaccaaccgtttcaaatatgtgcgacaggttcatccttgattaaaaatggcttgccatcgaatacagagtatgtgataacgcatatgggtaaaacgaggtacagttctgtatatgtgtggcattttcagtaaagaagttctgagtaaagacgttagcgttgaataccgcttctctgccgatccttatcttagtgcctcaagcagtaacgactctagtttgtctatgtaaacgcctacgggcgagttaaacaatccaaaggaaatactcaagatggcaaagatcaaaggtcaagttaagtggttcaacgagtctaaaggcttcggtttcatcactccagcagatggcagcaaagatgtgtttgtacacttctctgcaatccaaggtaatggcttcaaaaccttggctgaaggccagaacgtagagttcgaaatccaagacggtcagaaaggtccgtctgcagtaaacgttactgcaatctaatcagcgtttgctgtaaaaacccgcctttgtgcgggttttttcatatttggggaaaccctatcagccaatcgccgtaggcggtcaccttttttaaggcaagatgaccactcccgaatattggttacggcctctaattcctgggtgagtagggtcaatggcttgctgttgactggttcgccggaaactggtgtatttgaattgaggtgggtgttcaccctctgattcttgtgtggccgtgcaaacggtacatgtagtgcaaacagtatatgtagtgcaaatagtacaactgccaacccggtctatttgttggatcccggcgttacgtaattggtgctcagcaatggcggctaaattcaggtggcgaaaccgaggtgagataatatgttttgccagcggtaattcattcataaaccgttcgaccagttcctcattgacttcataacagcaagagcgtgccgcaggcccgatggcggcaacccagttggtagggttgtcatcacgggaaatacgttcaaccatctgtaaaacgatcccctctaataacccgcgccaaccggcatgtacgacggctaccccttttccatgacgctggctgaaaataatcggtaagcaatcagccgtgagcaccgacaagagaatacccgcctgagtggtatagaggccatcggcttccccacatgcttgcccaacctctgtcacatcaacaatttggataccatgaacctgtttcttattcgcttgagatgcctgatagggcttaaggcagtcaggtaataaagcagatttattaccaaaaccatggctgatggtggctatgcgactgagtcgtggtgaaaaatcggtcataagatttacctgatgaagagaagagaatggccgactcagtgtaagccgttttttaatttattgaccagtcaccttttattattagcccccccattcgtaaattgttgcaaaataaaaccgcggtatcactgtttccctctattgccgccgaggatagggcttaatcgcgagtctttgttcggcgctattaatatcttggttgtcaccgctaatatcttggttgtcaccgctaatatcttattgtcgtagttaatatcttgcttgttgcaataaatattcgggggattcaatgagctaaaggacggccactgacttgcaaccgggggtgtgcttctttagactaacgccgcatctgcccgctatcttggcggttatttatctgttatctggaattcaaccatgtcttatcagtgtcctctctgtcatcaagcactgcagcttagccaacagcagtggtgttgtagcaataatcatcagtttgattgcgccaaagagggctatgtcaatttaatgccagtacagcataaaggctccaaacaacccggcgatagcccagagatgatgcaagcacgccgggcttttcttgacgctggctattatcagcctttgcaacaacgggtaagcgagattctggatgaggctttgccgcttgatgcaaccaggttattggacatcggttgcggtgaaggttattacacggcggcggtggctgatcggctaaataagttgcgccaaatggctatttttggtctggatgtggcaaaagtcgcggtaagatatggggctaaacgctaccatcaggtcaatttctgtgtggcttccagccatcgtttaccttttgccaatggtgcactggatgccgtattacgcatttatgcgccttgtaaggcggtggaactggcccgcacggtaaagcctggcgggatcgtggttaccgtggcacccggccctcgccatctctatcagttaaaagcacttatttatgctcaggtgcaactgcatgatgatacagaagaacatcttgatggttttgagttaatccgccgcgaaacattggcctatgacatgaaactcacgggtgagcagggttttaatttattacagatgaccccgtttgcctggcgagcatcggttgatactgggcagaaattggccgctcaaccgtcttttagttgcgagactgatttcgtcatttcactgcatcgtcgtaaaacagacagtcctcagaacgatatttaatgttctggtccattctctgggactattcgctttatatcccctgtagttgcaggggagtattgctgagtaaattaaattttaattataatccactgaaataaacaagccattccgcagtgatattatttattttataatgagaatgtaaatttccctagcgaagtattaatataatacttaagtcaaatttaaagttttttgtttatagaatacagggtgaattattttaggtccagatttcgccaggttctaccgctagattcggtgactaaaatcgatggaataaagcggatctcttcagcaatttttagcgctaaatcagccacttcctgtttgttgagtatgccgctaccatagttgaactcgccttcaggtaatttatagaccttctctctaccgatcaaacaggtaaaaccggagtcaatcatttttttattaagtttttcataatcaccttcaatggcgttatgtaaaacgacactaaccgtaaagtacggcatatctatccttcagattaatcaatgatgatatttatatatcatatgcatataagcgatatattgatcaggatcgaattgctgaaaataccgatgtttatattatggggcgttcggaaacaaggctaattcacttttgggccgcatcagtattcatgctgagcagagggaggggccaatcataaaaacattgcaggtgacatgatagccacccgcaatatacctcaagaggtgagtgacaattggttgcggccagcatgtttggccttgtagcaggcaatatcggccaaacgcatcgcttgcgaagcggattcagtttgttgggtcaatggtattgcccccagactggcagtaaggacataagattgtccgtgccaatgaaactggatggcggcaatatccgccacgacctgttccagtatttctgccgcagatttactggggcaattaaagagcacaatcgcaaattcatccccgcctaaacgggcaacaatatcgttttctcgcaccgcttgttgcatggtttgtgcgaccattctcagcaccatatcccccgcttcgtgacccgcattatcattcacatctttgaaatagtctaaatcgacatagcaaagtatatgttgcccgtcatgagctaattgattaatcgctagtgtcaatcgctcttccaatcgtcggcggttaattaacccggtgagcatgtcatggctagcctggtattgcagcgcccgctgttcatggcgtgcacgggtgacatcttggaataccacgacggcgccagtaacaatattgtcacgatcacgtattggtgaagctgaacagcgtatttcttggcgttctccccagcgagataccagataatggccttctggtaatagggtctgtcgtccttcagccaggcattgactgaaggcctctaattgatttttatcctgtagtggagaccacaaaataaagacctcttcaatcggtaaaccacaggattcattttgcctacagcccgtcatctcttcagctttcgggttcattaataccacccggccttcactattgagagagataatcccatcaggaatggatgacagaacttgatgtaactgttcgcgctcttcatagcgggcagcttcactggcgcgcagggcatcttcgcgttgttttcgctcactaatatcacggatgagtttggtataacccaacagtttaccgttatggtcatgtatcgctgtaatcacggtaagcgcccaatagcgggtaatatctttacgaaccaaccaaccttcgtactctatacggctcgctgacgccgctgttttcagcagttttcctggtagccctgcaacaaggtcttccggcaagaagaggcagccgaaatgctggccgataatctcgttactggcatagccaatcttgtgttgtgcaccgtgattccaggtattaacccgaccccaagggtctagcattaaaatggcataatcttcaacagaatcaaccatcaggcgaaagcgttcttcgctgatacgcaatgtttcttcacgttggtggcgttcagtcaagtcgcggacaatcttggtgaaacccaataagtttccttggtcatcgtgtattgggctaatggcgacactggcccaataacggatattattcttacggacatgccacccttcagtctggaaattaccttctgctaccgccttggcgagtgatttttccggtacacccgccgaaatgtcctcctgcgtaaataatagagtaaagtgctcaccgattatctcctcacgggtataaccttcatgccgttccccccctttattccaggtaaggatgcgacccgcagtgtcgatcatgtagatggcacaatcttccacttcactgatcagatgacgaaacagctcttcacttttccgcagtgcattatcccgctgccattggtcggtcaggtcacgggtaacatgaacaaagccctgcaaaatattttctgagttatgaagtgcactgagagtgacgttgccccaaaaacgtttgccatttttgcgcacacgccagccttgagattcgtaatgaccaaactgattagcgtgcttaagccctttgactgacaagccgttcactaaatcttccggggtataaaacagttcgaaggattgaccgataacctcttcggcacaataaccggtattgcgttctgcgccattgttccaggtcagaacgtgccccttggcatcaatgatgtatatggcgtaatcatcaacggactcaattaataaccggaaaacatgatcgtcaaatgatgccgggtacaaagccattcctatcttttccttgaatgtttattcaaccaatcgttggttgagtcgtgcgacagcgagaatatttaatttataaagggggaacgatattgcgcctgtctattgctaacaagggataaccgtgaattctttcactgttattacccctcaagccttgatacctggcatgacaatgtcatgtcctccctgcttatcgccacgcttaaccctgtctctcgcgatagccaaaaaagccaggaaacgagcgactgaaatacataaaggcttgcattggcaaaggttatacggataatccccaatccttatgataagcattcgtattactgttaggtgtataggctttatgggtatcaacacgatgaatcagtctctctccataagtacggagccgaaacgttcggctcctcgtcttttgtgcgtcatgatcggcgtagcattaggatctttatccgcatcttcatggtccgcagcagtggctaacagtactaaaacggccagcgcagtcgcagagaccaacagcgccgagagtagcaataaagcggataccattaccgtggttgggacaccagacacgttccgtgcaggggggaatgatttgatcccgacctatctggatggacaggtggctaatggtggccgtattggttttctggggcagcaagatgcccgtaacgtgccattcaatattatcggttacacctcgaaaatgatcgaagatcagcaagcggcgaccattgctgatgtggtcaaaaatgacgcttcggtacaaaacgtgcggggttatggtaacccatcacagaattaccgtattcgtggttttaatctggatggcgacgatatttcattcggtggtttatttggtgtgctaccgcgccagattgtttctaccagcatggttgaacgagtcgaagtctttaaaggagctaatgcctttattaacggtatctcgccaagtggcagtggcgttggaggcatgattaatctggaacctaaacgtgccggtgatacgccattgactcgcgttactgtggattatggttcagcagcgcaagtggggggagggctggatgtcggacgtcgctatggtgataacgatcaatatggcgtgcgggttaacgtactgcatcgtgaaggtgaaacggccatcaaagatgagaagaatcgcctaaccgcggtgtctaccggccttgactaccgtagtgatcgcgcgcggacctcattggatgtgggttaccaaaagcaaactattcatcatatgcgtaccaccgtgggtgtcggtgcggtgaccgttattcctgaaccgccgtcaaccacactgaactatggtcaaccgtgggtttataccgatttggagaccacgtttggtatgttgcgtagcgagtatgatgttagccagaactggacggtttatggttccatcggggccagccataacgaagaaacggggcaatacggctcgccaatcctgacggataacagcggcaatgcgacgatcagccgtttatatgtgccttatatttctgagtctattgccggtttaggtggtattcgtgggcattttgatactggttttatcacccataaagtgaatttagggtatgcaactaattatcggacaaccaaatctgcctttaatatgtccgagagtatcaataccaatatctataatccgggggtcatacctttcccgccaacatcgactaatcccaatttttatagtcccaaccaagatcctacgttgacgagtcaagttagggcttccggcttctcattgtccgataccttatcgatgatggatgacaaagttcagctgatgctgggggtacgccgccaggatgtcactatccgtaattttaataatggcgtaccaaacagtgctggctcattagatgcgatgaaagtgacgccaatttatggtgtgctggtgaggccatgggagaaggtgtctctgtatgccaaccatattgaagcgttggggccgggtaagtccgcaccttatagctacagtaatgcgagtggcgtgacgacgcctgtggctaacgcaggccaaatccctggtattgttcactccaaacaaaatgaagtcggcgtgaaattcgataaccagcgctatggcgggacattggctttatttgaaattacccgcccgacgggcacggttgatcccgcgaccaatacttatggtttctatggcgaacagcgtaaccggggtgttgaactgaatgtctttggtgagccggtattgggtactcgtttgttagggagtgcggtttggttagatcctaaactgactaaaacccaaaatgggacgaacaacggtaactatgctgtcggtgttgctcgttaccaattagtgttcggcggcgagtacgatatcccttcagtagaagggctgaccgccactggcaccctgacacgttctggatcccagtatgccaatgacgcgaataccttgaaaattaaaccgtggacccgcctggatctgggcgtgcgctataccatgccaatgaaagagactaacctgatatggcgcgctaaccttgaaaacgtgactaacgagcgttattgggaatcgatagaagatagcggcgtttacctgtatcagggcgatccacgtacgctgaaattatccgtctccatggacttctgataagttgcggcgactttgctgaaatagtgattgagtgaactgttgtttactaaacaggtgctttactaaacgggtgctttactgaaatcccccggcgatttgatatatcgccgggggatttctcatttatcgcgcagcagtactttatttacagcgagaataaaagagcggtgcttttaggcagtaaggtgcatatgttcatacagaatattaaagccgataccgatcaatacgatcccgccgataatctcagcgcgcttacccagtagtgggccaatgtagcggccaatcagcatccccagcgttgccataatcatggtggctaagccaatagccatcgcggtgtgtacgatatccacttgcaagaaggccagaccgacgccgatcgccatcgcatcaaggctggtggcaatggcggttgtcaccaacacccaaaaactgtgactgcgcattttttccgtttctgctacccgctgtttcataccttcaaaaatcatacggcaaccaagaataaacagcagactgaaggcaatccagtgatcccattccataatatattggctggcgaacaggccgatacaccaaccaatcagcggggtaattgcttcgatgacgccaaaaatcaggccagtacgcagtgcttcacgaaaacggggtttatacagcgtggcacctttgccaattgacgcagcaaatgcatccatagacatagcaaaagcgagaataattgttgcagatagattcatagaaatagtctcggccgggcggctccatatacacgtaacccacccccaacctaacgacggagctacgtgtctatggtctcgccaaccttacctggctgcccgcaccacgtttcaaataaatgaaacgagtatgttgatacgggcgtttctgcttgccaatatattatgaatatattgcacagaaaccggctactccccatgaacggcgcaaccttaacatataaaatcgaatgccgacaaccccaaatacaatatggtatataatcgctattgataatgattttcattatcaaattaagtttaaaaaatagagcgtataagcatcagtaacggtgtggaaataaacagaagaaaaattttaaatcttgctggggaattaatcattcggttgtagcataaattgatgaattccccagaaagaaaaatgtttatgattgattttcaatgaaaaaattatatattttttctaagtcatctaattttttaacctgaatgagtaacctgcgctgctctaaatcaatcacgaggattccatcttcagataaattcatactttttattcggctatattcaataaaagtattagcatagaaaaaacctgtattcttaaacaacaacttgggccagcgaatatacgaaatataaactgcaaccaaggctaaacccactaataaataggtggttaatggcgcaccatgggccataacattattgtaaataagaatgccaatcagtccgacaaagatcatgcaatcgagtttgtttttacgtttcaggtgaacttgtagtcgagttttacccttcatcatgttcatgatgaattcatcatagatggcataaatgagtagtagggcgataaaaacaactaaaacaagatcagtaaccgacatgcaacaactcctgtatacccttcgaatctggagttgtaaggggggttagctacgcgtattcactcgccgtgtaagttcagcgggattcattcgcttgccgcctacctgcaacgccaatttttttgagtttcgaacggtgtctaaaagataaaataaccgggagcaagcccccggttttggatgaagataatcgccagagttatggtgccaagaagccaatccagtagccaaagataccgatagcgaagaagcccataataatccacagtgcgttaactttacggcgcaatagccacatacaaccgaaggttaatagcagcggcactaagcctggcatcaactggtccaagatcgtttgtaccgttgttactgtggtttcgcccgccgggttggttatcctggacaccaccaccggtatgttgacgtgcgtccacttgttaaccaaggcccccataacaaacaggccgaggatagacgccccttccgtcagtttctgcaggaagccgccgcccatatcattaacgatattgacgccttttttgtagccatatgccacaccgtaataacgggtcagcaaacgcaccacgttaaacagcacgaagaacagcaatggacccagtaagctaccgctcatggcgatacccgcaccgagagccgcaaacactggacgtacggtaccccagaagatcgggtcaccgacaccggccagtggccccatcagacccactttaatgccgttaatggcagcatcgtcgatctcagcaccattggctctctgctcttccatcgccaaggtgacgcccagaattggcgcggccacgaaaggctgggtattgaagaattccagatggcgtttgatcgcctgcttacgctcttccgagttctctggatacagacgacggatcgctggcaccatggagaaacagaaacccagcgcctgcatacgctcgaagttccacgacccttggaagaggtttgaacggagaaacacaccgcgaatgtcgctggccgtgagtttcttttcaccggtagttgttttagtaacagttgttgtatcaacagttgttgtatcaaccatttctctcaccttttcctagtctaattcgttatcaagatcgttattggccgggccagactgtacaacctgagacttgttgtatttagggctgacttggatataaagaacagccataaccacaccaataacccccaatgcaaccaggttgaagttggtaaatgcggcagtaacgaaacctaaatagaagaatggcatcaggtagccagcacgcatcatgttgataaccatggcgtaaccaacgacaacgatcataccaccggcgatgttcaggccactggtaaccacttcaggaattgaactgagcatcatctgaacttcagatgtacccacggacagagcaacgataagcgcgggaatggcgatacgcattgcctgtaagaacagggcagagatgtggagccaggtaatcgctcgtagactgccacgttcggcagcgccatcagcggcgtgttggaaggccacggtaatggtacgcacgataatagttaacacctgaccggctgcagccagtgggatcgccaaggcgataccggcaccgatatcttggcccccggcgataaccaggatggttgaaataattgaggccagagccgcatcaggtgctacagcagccccgatgttcatccaaccaagcgcgatcatttctaaggtaccaccgatgataataccggttttcatatcacccagaaccatacctaccaaggtacaggcgacgagcgggcggtgaaattggaactcatccagaatggaacccatcccggcgatacatgcaacgataaatatcagcacaatctgaagagttgttatctccattgtacttctcctatgaccaataaagctgagtaaaataaccaagccccaaaataggacagggtattacctttctacgtagtttttagtggagctatttatttaatttactaatcaaatccatcattttgagccggctatccgaagacacttttcggacttccaattcaataccgcgagcattcaatttgttaaacgcttcaatatctttttcatcaatggagacggcattgttcacctgggttttcccctgacggaatgccataccaccaatattgactgatttaatgtctacaccgccctcaaccagacgaacaacgtcagtcgggttggtaaagagcagcatgaccctatcattggcatatttcgggttgttataaacgcgaatcgctttttctacatcaaccacgtgtgcggtaacaccgggaggggcaacttgcgttagcaaggttttacgcattttgtcggcagcaacttcatcactgactacaataatgcggtttacgttagtttctttggtccaacgggtcgcaacctgtccatggattaagcggtcatcaatacgtgccagcccgatcttcatatgatcgttcggacctaaagcaacggcaggagccttggctgttggcactggagctgcgggttgtgtctcgggcttatcacttttaacatcaggcgcttttaaggctttcacaccctcgcggccggtctcgacagctactgcaaccaattcagcgaatgacggctcatcatcacgagccataaaggtttcagccagcatcggaatgttaacgccagtgacgacctcatagttctctttatcgatagcaatgcgactggcggcattaaacgggctaccaccccaagtatcgaccaagaatagaacacctttactggtatctagcccggtcaatctatcgttgtacttctcaatcaacgtttcagcattttcacctgggacgaaatcgatataagcaacattactctgttcacctaaaatcatttcagctgttttaagcagttgttctgccgcagccccatgtgtgccgatgataatagctatactcactcgctaccccctctgttaactcaaaattgagttattgcactaacagaaaaacaactcatcaccaaaaatactgttgagctacttgaatctattatgatagtcgcaatattcgcttgtcgctgacgatttgcatctactattaatgaatcgattcaggcaaccgttctcagtaccccagtgtgatttattttagtcagtgaaaaaataaattatgtgacattgctcatctattaggagaagttatgaatgatttcgcctacttggataaattatcatcatttatgtgacagacatgtgtatgagggcaggtatgaacaatcatgatattgccgtgccggtggtgctccgaacccatgaaatcgccatcgaatcgttattccttaatttcattagatggtggtttatatagaactaatgaataaatgcgactatgccaacaaaaaaaatcctgataaagttggcgtctcttttcattgtcaggagttaagggcctcagctctccctatggactgtcaccgaagttactgtttctttagcgttaacacccaaccaatgggtttaaatctggttattcaatcacgcaccttagctgcgtatcatttcacccgatctttctgtgtatcagtgctgacaaccgtgcagcggcgttttgccgtctctgttgcagggcgcgcatcatctggatcatgttcttattttcggagtctgacatggaacttttaatggacccctcaatttgggcagggttgcttacactggtggtattagagattgttctgggcattgataacctggtatttattgccattttggcagataaactgccgcctaaacaaagggataaagcccgcattatcggtttatctctggcattgatcatgcgtttggggctgttgtcggtcatttcatggatggtcacgcttacgacaccgctgttcagcgtcggtgcgtttaatttcgctgggcgagatttgattttgctggtgggggggttgttcctgctgtttaaagccaccaccgagctacatgaacggttagaaggtaatcagcacaatgatggggcgaaccggggctatgccagcttctgggcggtcgtggtccaaattgtcatcctggatgcggtcttctccctggatgcagtgattacggcggtagggatggtcaacgacttgcctatcatgatgacagccgtggtgattgccatgggggtcatgttactggcctcgaaatccctgacccgatttgtgaacgagcacccaacggtggtcgtgctatgtctgagcttcctgttgatgatcggcttgagtttgattgccgaaggttttggcttccacattccgaaaggttacctgtatgccgcgattggcttctcaatcttgattgagttgtttaaccagattgcgcgtcgtaacttcatcaaacatgaatcgcgtttaccaagacgtcaacgtacagcagaagcgatcatccgtctgatgggtgggcgtcagcagcaggaacaacagagtggtgaccctcaacaggcagtaccaacagaagcctttgctgaagaagaacgctatatgatcagcggggtattaacgctggcctcgcgatcattacgcagcgtaatgacgccgcgtaccgaaatttcttgggttgattgcaaccgttcacaagccgaaattcgcgagcagttgttagataccccacacagtttgttccctgtttgccgcgactctttggatcaaatcattggtgtggttcgcgctaaagacctgctggtggcgattgagcggggtgagtctatttgtgattttgccgcgacaaccccgccaatcgtggtgcctgataccatggatgtgattaatctgttgggggtattgcgcaaagccaagggccgcctggtggtggtgaatgacgagttcggcgtggtgcagggtctggtaacaccgctggatgtcctggaagcgattgccggtgaattccctgatgaagatgaaacgccagatattattgccgatggtgatggttggttggtgaaagggggggcagatctgcactcgttggaacaggcgctggattgccagacactggttagcccaaccgctgattatgcctcgttagccggtttactgttgtctcattcgggccatatgccaacggcaggggatgtgattgagctgcataacctgcgcttccagattatggacgtctcagattaccgtattgagctggtgcgcattaccaagctgagtaatgagttggaagagtaagcagagagtggaacctcaggggcgcttcggctcccctgaggttattgacaacgtacccgcgacggaggtaacagacagaacgcaaagacgccgtaaacccatcactcttcatcttctaacatctcattttctgacatctcattcgcttgccgatgtttattacccacggtaatgaattcatccagcagtaaagagagttgcgccattttatctggtgaaaatgctgcctcaattagcctgtaaccttcttcaacctgtggccgagcgttgtcatacaaattttgtccctcctgagttaaggagacataaagtttgcgctgatcgttgacgggtttgaggcgaaaaatcaaattgttacgctccattcgcgtcaaaatccccgttaggcttggacgtaaaatacaggtttggcgggccagcccatgaaaatctattgagcgattatccgcgagcactcgaatgatccgccattgctgctcagtcagatgattggctttcaagataggccgaaaaaaagccatagcggcttcacgagcctgcaataatgcgatggtcagtgattcatgcataagtaacaacgactcgacgttagtaatttatcctctcctagagggaggctctgctgtttttagtatacggacagatgggccagacaccagcgattccttacacaaaaaaaccatctgtttttcattattattaatagcttaataataaatttacggccgcgctaacgcctgattttattttatttaacctgtttaaataaatatagttatttgttttttaaagataatttatttattgtaaataaattgttatcaagatcacgaatttaaaatatagaattggttaattattgacctattgattcaaatgattgttaatatgttaactatgtgttgggcggattctgtctaagccaaaaattctgtctaagccaaaaggaacattgcatgaaaggtaccgtatttgccgttgcattgaaccatcaaagtcagatagaggcttgggatagcacctttcatcaggcaccttataaccgccccccgaaaacgccggtgtggtttatcaaaccgcgtaataccgtgatacgccatggtgatggcatcccgtacccagagggatttaccgtgatgagtggtgccaccttggcactggttgttggtcaggttgcccgtcatgttgccttaaaggacgcggcgtactatatcgccggttttgcggtagcaaatgaagtcagcttgccggaaagccatttttaccgtcccgccattcaagcaaaatgccgtgatggattttgtcctttgggcgatctggggccgtttattgatacctctgcgcttgagattattaccttgattaatggtcaagaggctgatcgctggtcaagctcggggttggtcagatcaggcactcaacttcttagtgcactgagtgaattcatcacgttacaaccgggggatgttctcttgttggggacgccactgcatcgggttgaactcggccttggagaccaggtgcaaatacaggttgcagggctacctgtgctggaaaatatcgtgatccagcaaggaagtaggccatgaaacatgctcgcatccaataccaaggtagtacctttcatgtcaccgtcgatccacaaggcaacatttgtttgccagatggtcgcaatgttagcagtgagcacgttatatggttgcctcctgcgacaggaacgttatttgcactcggattgaattatgttgatcacgcggcagaattggatttcagccccccgaaagagccactgatttttattaaagcgccccatagcttcaccggacatcgtcaggtttccgtccgccccgataacattgaatatatgcattatgaagccgagctcgtggtcgtggttggcaaaccagcgcgttacctcaacccagctcacgccatggattatgtagccggttataccttgtgtaatgactatgccgttcgtgactatttagagaactactatcgtcccaatctacgggtaaaaagccgcgataccttgacgcctatcggcccatggatagtcgataaagcggatattcccaatcctcataatttggttattcgcacttgggtcaacggtgaattatgccagcgaggtaacaccgccgatctgattttcgatattccttttctgatggcgtatctgagtgagtttataaccttacaacccggtgacatgatcgccacgggaacgcccaaaggcctatcgaatgtggttccgggggatgaagtcgtggttgaggtagatggtattggttgcctgcttaaccgtgttatcagccaaacagactatgaggatggattgctatgaagatcgttaaccattggattgatgggaaaaatattaccagtaaggactatttcacaacaatcaacccggccactggcgaggtgctggctgacgtggcaagcggggggataaaagagatcaaccaagccgttgctgccgcgaaaagtgctttccctcactgggctaacctgccgatgaaagtgcgtgcccgtctaatgcgccgtctgggggagttgattgagcaacagatcccagaaatagcgcagatggaaacgcaggataccggcctgcccatttatcaaacgcaaaatgccttgatcccgcgggcagcacataacttcgaattttttgccgaaatttgtcagcaaatgaatggccagacgtatccggttgacgatcaaatgttgaattacaccttggtgcaacccgtgggagtgtgtgcgttggtctccccttggaatgtcccttttatgacggcgacctggaaggtcgcgccttgtttggcgctgggtaacaccgcgatattgaaaatgtcggagctatcgccactgaccgcagacaaactgggtgaactggccttagaggcgggtataccggcgggggttctcaacgtggtacaaggatatggggccactgtcggtgatgcattggtatgtcatcaggatgtccgagctatctcttttaccggcggcaccgcgacgggaaaccgcatcatgcaacgtgccgggttgaaaaaatactccatggaactcggtggtaaatccccggtacttatcttcgacgatgctgatatcgaacgggctatggatgcggcgctattttccatcttctctctcaatggtgaacgttgcacggcgggttcgcgcatttttattcaagagagtctctattcggcatttattcaacgttttgctgagcgggccagccgtttacgtgtgggggacccacaagatctcgacactcaagttggcgcattgatcagtaaaccgcattgggacaaagtttccggctatatccagttggggatagaggagggggccacgttgttggcaggggggccggataaacccatcgacctacctgctcatctgcgcggagggcacttcctgcgtccaacggtgttggccgatgttgataaccgaatgcgggttgctcaggaagagatttttggaccggtcgcttgcctgatcccctttaagaatgaagacgccggactgcgtttggcaaacagcgtgccatacggtctggctgcttatatctggacacaagacgtcagcaaagtgctgcgtttggcccgaagtattgaagccggcatggtgttcgtgaatacccagaatgtgcgggatctccgccagccatttggcggcatcaaggcatcgggaaccgggcgtgaagggggaaagtacagttttgatgtttttgctgaagtgaaaaacgtctgtatttccatgggggagcatccgatcccccgttgggggatgtaacagacatcatcgccgcgggttaaatcgcaatcaatatcagagaggcttatcccctgataatcgacggtttcgtgcggattttatcaagaaaacccactgagttttcgagcgaggatgtatgggaaaattagcattagcagcaaaaatcacccatgtgccttccatgtatctgtctgagttaccgggaaagcaccacggctgccgtcaggcagcgatcaatggtcatcttgaaattagtcggcgctgccgtgaacaaggggttgatactcttattgtttttgatacccattggctggtgaacagtgtgtatcacattaattgcagtgactctttttccggggtttataccagtaatgaactgccacatttcattcgcgatatggcttatgaatatgagggcaaccccgcgctggggcaaatgattgccgccgaagcctgcaagttgggggttcgtgcacaggcccacaatattccgagtttaaagctggaatatggcacgctggtccctatgcgttatatgaatagcgataagcactttaaagtgatctccatttcggctttctgtaccgttcatgcctttgatgacagccgtaacctgggtcaggccatcatcaacgccattgaacactatgatggcatcgttgcagttttagccagcggctctctctcacatcgctttattgatgatcaacgcgctgaagaagggatgaatagctacacgcgcgaattcgatcatcaaatggatgagcgggtcgtcgagctctggcgagaaggtaaattcagcgagttctgccaaatgttaccggaatatgcccagtactgttttggcgagggcaatatgcacgataccgtcatgctgctcgggatgctgggatgggataaatacgatggcaaggtggagtttgtcaccgatctgtttgccagttcgggtaccgggcaggtgaatgcgatattcccattggccgtttacgggtaaatctcactgataaggggagaggctatggcgcatttctacgcagaatgtacggacaacatccgtgaacaggccgaattacccgtcttgttttctaacgtaaatcaaactctggtcaacacgggtcttttcccattggcaggtattcgcagccgtgccatttggctggatacctggcaaatggcggatggacagcaagactacgcttttgtccatatgacgctaaaaataggctacggacgcagtatcgagcaccgacaggcggtcggaaagacattgtttgccttgattcaagcgcatttcgcagccctgatgtcccaacgttatctggctttgtcgttcgtcatagaggagctggatccaacgcttagctttaaacagaacaatgctcatacattgttccaacagggaacctctgcatgttagctcaaaagacgattatccaaattgcacaacagctataccaagctgaacagtgtggtgaacaaatccgccaagtctcgctcgattaccccatgataaccattgaggatgcgtatgctatccagcgtcaatgggtggccatgaagatccaacaagggcagatattgaggggccataaaattggcctaacctcgaaagccatgcaaaccagttcccaaattaatgagccggattacggcaccttattggatcagatgtttttcgccgatggcagtgacattcccattgaccgtttcattgtcccgcgccttgaagtcgaactggcatttgtgctggacaagccgttaagtgggccaaactgcactctgtttgacgtttacaacgccactgattttgtcattccggcattggaattgatcgatgcgcgtagccatcaaattgatccgcaatcacaacgccctcgtaacgtctgcgacaccatttcagataatgccgccaatgcgggggtgattctgggagggcggcccgttaaaccgacggaactggatttacgttgggtcagtgcactgatgtaccgcaatggcgtgattgaagagagcggcgttgccgcggcggtattgaatcatccagctaacggggtggcctggttggctaacaagctgagtgcgtacgatataccgctggaagtcgggcagataattcttggtggatccttcacccgcccggttccagcgcgtcgtggtgatactttccatgtggattatggcccgttaggtaccataagttgccactttgtttaggggcttagtgatgtttccattaacaaataaatttaaacaggcactgaaagcaaaaaaaccacaaattggcttatggctaggtttgtgtagcaattacagtgctgaaatcctggccggtgcggggtttgactggttgttgatcgacgatgaacatgccccgaatgatgtacaacggatcttagggcaattacagacgatcgcgtcttatccgagccagcccgtggttcgtccggcgtggaatgacccggtaatgataaaaaaattgctggatattggcgcacaaaccttattgctcccaatgatccaaaatgccgcacaagcgcgcgctgcgatcagtgcgacccgctatcctccgcaggggattcgcggcgtcggaagcgcgctggcccgagcttcccgttggaatagaatcgcagattatgtgcagcaagctgacgaacagatatgcgtattgctccaaatagaaacacgcgaagcactgcgcaatctacccgagattttggcggttgatggtgtcgatggtgtgtttatcggcccggccgatctcgcttctgatatgggttttgcgggtaatccacaccatcccgaggtccgtcaagccatcgatagcgcagtgatgaaaattaagactgccgataaagcggccgggatcttgatgaccacgccagaggtggctgagtattatctgaaactgggggcactatttgtggctgtaggtgtagatacgacgctattagcacgcacagccgaggcactggcagcccgcttcggtgtgggtaatcatcatccaccgcttgcaccatcgggtggatattaaccctgtccgtatcgaggacattatcatgagcgattcactgtctaccgcaccgggcgttaccccgccggtcaataaaaacacaccattaagtgcgcagcagcagtccgtcattaataaactgtttcgccgtctgatcccgttcttattcttgttgtttgtttttgccttccttgatcgtatcaatattggttttgcgggtttgacgatggggaaggatttagggctaagtgccacgacctttggtttagcgactacattattctacgtgacatatatcttattcgcgatccccagcaatatcatgttggggatcgtgggtgccaggcgttggattgcgaccattatggtgctctggggtatcgcctctaccgcgaccttatttgccgtcggccccaacagtttgtatctcttacgaatgattgttgggatcaccgaagccggttttttacccggcattctggtgtatttaacttattggtttccggcccactttcgagccagagccaatgcgctgtttatggtggcgatgccagtgactatggcgctcggctctctggtttccggctatattttggcgcttgatggttttttgaatatgcgtggttggcagtggctatttctgctggaaggctttccatcggtcttgctggggggggtggtctggttctatctggacgataccccgcagaaagcgcgctggttaacgaaagaagataaacagtgtctgcaagagatgctggagagtgaccgtttgcaattggcgaaacaggcggattatggtgccttaccacaatcagcgatgtggcgggaaattttcacccccgtggtgctgatgtatacactggcttacttctgtttaaccaataccctaagtgcggtgaatatttggacgccgcagatcctgcaaagttttaatcagagcagcagcaatatcactatcggtctgctggccgctatcccacaagtttgtaccattgccggcatgatctggtggagtagacgctcggatcgggttcaggaacgcaaaatgcacacggttttgccgtatctgtttgccgcagcggggtgggtgctggcatcggccacacaaaatagcgtaatccagttgttagggatcattatggcctcgaccgggtcatttacggcgatggcgattttctggactacaccggatcaatccatcagcctgagagccagagctgttggtattgcagtgataaatgccactggaaatattggttcggctgtcagcccggttttaattggttggttgaaagaccagaccggtaactttaattccgggctgtatttcgttgccggtttattggttatcggggctgttattttcttgatgattccaatgaaaaaggcacctccaaaagccattttctaatgggctaagggacccacgccgacaagaatgtcagcgagccggtctttattttgatgacgaggtaaatatgaagccagaaaatttccgagcgaataaccaacgtccttttacccataaagaatatctggacagtttacaagatggccgagagatttacatttacggcgagcgagtgaaaaacgttaccactcatccggcttttcgcaatgctgcggcgtccattggccagctatatgatgcactccatgaccctcagtcccatgaacagctctgttggaatactgatacgggtaatggcggctatacacataaattttttcgctatgccactagcccggcagagttacgtcagcaacgggatgctattgcccactggtcacgtcagaattacggttggatggggcgctcaccggattacaaggcagcgtttggcagcgtattgggcgcatttcccgagttttatggtcaatttgcggataatgcccgcaattggtatcagcgtatccaggaatccggcctctattttaatcatgccatcgtcaacccgccccttgatcgccataagtccgcagatgaagtgaaagatgtgtatatccatatcgaaaaagagaccgatgccggaattattgtcagtggagccaaagtggtcgccactaactcggcattaacacattacaattttatcggttttggatccgctcaagtgatgggggaagaccctgattttgcgctgatgtttgtcgcaccaatggatgctgacggtatgaagttgatttcccgcggatcttacgaactgatggtgggcgcgacaggctccccgtttgattatccgctctccagtcgatttgatgagaacgatgcgattttagtgatggataacgtacttatcccttgggagaatattttaatctaccgtgattttgatcgctgccgtcggtggtctactcagggaggattcgcccggttattcccacttcaggcttgtacgcgtctcggcgtgaaactggactttattaccgcattgctgaaaaagagtttaatgtgcactggctcactggagtttcgtggtgtccaagcggatttaggtgaagtggtcgcttggcgtaacgtgatctgggcgttaagcgatgccatgtgcgccgaggcgaaaccttgggtgaacggcgcttatctacccgatctcgcagcattgcaagcctaccgcgtcatcgcaccgatggcatactgcaaaatcaagaatatcattgagcgtacgctcgccagtggtctgatttatctcccctccagtgtccgtgatctacaaaatccggctatcgacaaatacctgtcgcgttatgtgcggggttcaaacggtatcgaccatgtagaacgcattaaggtcctgaaattgatgtgggatgcgatgggcagtgagtttggcggtcgccatgaattgtatgaaattaactatgcgggcagccaggatgagatccgtctgcaatgtttgcgtcaggcgcagggagacggatctatggaccagatgatggcgatggttgatcggtgtttgagtgattatgatactcagggctggacggttcctcatctgcacaataataacgatattaatcaactgaataggttaatgaaataatcaggtaccaggaggtttatatgtcaacagaaaatcaacatcatctgtgttttcgtgacgcgatggcctgtttatcggcagcggttaatattgtgaccaccgatggccctgccggacgttgtggcattacagcaaccgcagtgtgttccgtgacagatacccccccgaccttgataatttgtattaatcgtaatagtgcaatgaaccctgtttttcagcaaaatggatgtttatgcatcaacgtactgaatcatcaacaagagcctatggcgcgtcattttgctggaatgacggggagcagcatggaagaacgtttcagttgggatatctggaatgtcggtctgctcggccagccgttgttacgagataccttagccagtttggagggggtgattgaacaggtacaaacgataggtacacatctggtttatttggtacacatcacacagatcgttctgcgtgagcaaggccatggtctgatttactttaaacgccattttcacccggtgatggtgtaaacctctaatgcccgtcatatttaactgacgggcattagaggttgttgacaacgtgcccgcggcggagagaacaggcagagcgtaaagaggccagcttccctgcataaaaatagccctccctgggggctagccgcgccatcctttactcccctgcctattcttaccgtttcagatcgcgtcatcggggtttgtcagctgtccgaagggcgctttgtgtataaaccggtcatacattggctcccctttgggttgtttcaagatagctgtcagcgaaaaaaatcaagtacactgcactttaatcgccaggccaccacgcgatgtttcgcggtatttggcattcatatctttacctgtttcaaacatcgtttcgataactttatcgagggagacgcgcggttcactggtacggcgtatcgccatccgtgcggagttgatcgcttttaccgatgcaatcgcattgcgttcaatacacggtacctgtacctgacccgcaaccgggtcgcaggtcagacctaagttgtgttccatgccaatctcggctgcgatacagacttggatcgggctagcacccagcaattcagcaagaccagcggccgccattgaacaggcaacgcccacttcgccctgacaacccacctctgcaccagaaatagaagcattcatcttatacaaaatcccgatggcaccagatgcgaggaaataacgaataaagatttcaggtgtcaccggttcgataaagtgatcgtaataggccagaaccgccggaacgataccgcaagccccgttagtgggtgccgtcacgacacgtccacctgccgcattttcttcattcacggccagtgcgaacatattgacccagtcaatgacaatcatggggtcactggacagcttatcggaagagaccagcaggcggcgtaatgccgatgcacgacgtggtacacgcagtggcccaggcagcacaccctcggtattcaaaccgcgatcgatacaggcgcgcatggtctgccagatggcggtgaaataggactcaatctcttctttactgtgcatcgccagttcattctgcatcaccataccggagatagacaggccagtttgctcgcagttggctaatatttcggcagcagagttaaacgggtaggggacgctaacgtcattcacgctggctttgccaaaattctcttcatcaacgataaaaccaccgccgatggagtagtatgttttgctgaggactttttcatcgccagcaaaagcatgaatttgcatgccattctcatgcagtggcagattatcgctgcggaagaccatcccgccttcacgggggaaatcgacttcatgcaggccatttgccaacatcagtttttggcgtaattcaacatcgcggataaacgcagggatgctgtcgatatcaacggtatcaggcaggttacctgccagacccataataatggcgatatcggtgtgatggcctttcccggtcagcgacagtgagccgtaaacatcgacggcaacacgcgtgatagacggcatcaatccttcggttatcagcaaatcgacaaattgcttacccgctttcattggcccaacggtatgagagctggacggaccgataccaatcttaaacatgtcaaaaacgctaatcacgctaaagctccttcacaaaaacctattattatactcagcgcctgattgatagggcttgagaacatttgtattaagtataaaactttgtggctagacgcgggtcactacacataataaatatccatacatgaagtgatgcaatcacagacctttattgatttgggggctactcggattagctgtgcctatttgatacggcaacggctacatttttctcttcctccagggaggataaaaaaccgccaaggagagtgaaaattatccctatttaacaaaatacgttctagttattcagctacggggtcaatggcccggtatattttggtctctaaacgttttctatctctaaacacggtctcgccattaagcctatttgggtaacagcttatgctgatattggccgcattaactattagctattaaccataactattagctattaaccatgactctcagctattaaccataactatcaggaattgaccttattttcttagtggtttatagcggcggataatattttacagatatttagtaatgccgatagaccattttacagtttttttaaaatgaatgtgcaaggaaaatagagtaaaaatcgaattgaggaggtgacaaggatcgctttatgctgttattactgttttttagctgcacgatgtgacggatgtcacaggttaacagccgccaaatggcggctttatgagtcaaatactgacttgctgcgccagatggcgaataatcgtggcggtcaggccccagataaattggttttcgtaccatgaaagatagacccggtgattgattccctcccgatgaatatccagcgaatggtagcgagagaggctcagcgcttcatgtaaggggatttcaaatagcccagccacttcttcgtcattgccgtaaaaagggatattggctggtactaatcccacaattggcgtgacgtgataaccactagaactgttcaggggagccagtttccctaacacatgaactacggatgccggaatggcgacttcctcttcggcttcacgtagcgcggtactaatcagtgactgatcgtcaggatcggccttcccacccgggaacgcgacctgacccgcgtgtttacgcaagtgatcagcgcggcgggtcagtaataatgtgggctctgggcggcaaataatgggtatcaatacagcagcacggcggttagtggcagaaaaatagtgactatgagtcaaaacgttatcgggttgcggcagttgtagttggaaacggttaataaactcggacaagtactgcccagtaattaattcactcacgaaataacacactcccccagttgcggtaaaatacgggcgaccttatcgaacgtttcttgatattcagcttgctcttggctgtcggcgacaatcccccctccggcagaacaatatatcttaccgttctctgtcatcagggtacggatagtaatattggtatccatggtgccgcagcaacttatgtagccaatgttaccgcaataagcattgcgtcgatagggttcgagttgttcaataatttccattgctcggaccttgggggcaccagtaattgacccgccggggaaacaggcgcgcagtaattcggtcggcgaacattttgggggaagtattgcggtaattgtactgactaagtggtgcaccgcaggaaaaggctccaccacaaacagctctggtacgcggacgctacccggacgtgcgacacggccaatatcgttacgcagcaagtccacaatcatgagattttcagcctgatctttggctgaattcgccaatcgctcagcttgctggcgatcctgctcaggatcggccaaacggggtagcgtacctttaatcggccgggtttgaacctgatgattctccaaccacaagaaacgttctggtgaaacactcaatatggcgttgtcgggtaagcgaataaaagctgaaaagggggcttgattgctacgactcagtgacagaaatgcttgccattcatccccctgatactctgcgctgaatctttgtgccagattgatttggtaacagtcaccgctacgcagatacgcttgaatttggcggaatttttcgccgtactgctcccgtgacatatctgcctgccatggaaccgtgagtttgaaggggacgaggttctcatcggttgtttgctgatgcagccaatgcaagcgctgttcggcatcgccaagggataccagcgtgagcttctgccgagagtggtcagcaatgagcgcccagtcatacaggccaatggccatatccggcaaggcgatatcgtgcgccgccagttcaggcaatttttcaactcggcggcctaagtcgtaaccaaatagccctaacgctccgccctgaaacggcagatcagggtgagcaggcatcgctggggcgaatttatccagttgctgctgcagcaaagagaagggatccgcgagggaggtttcctgcccctgatcactgacaataaccgttttatccccatgagttgtcagcgttatttttggatcagcgaccaagatatcaaagcgactatgggggtgttgagcaaatcctgagtgcaacaacatcgcccaagcttggttggcaagtggggtgaattgttgaagcagggcatcagggtgataaggtaactctttgacggttaaaaatttctcacacataggtcgctattcttttctttcgaatggtcataaagagatgtcttatgtacatgttggcaatgggctacaaggctgcataaatcactaagacagtggtggcaggagtttaccgcaggcaggaataaacaggtatactcaataaattatatgtaggagatcaatagatgctagcgggtatgccttcactttcccatgaggaacagcaagaagcggttgaacgtattcacaaattcatgtctgaagggatgagcagtggtgaagcgattgcattggtggccgcagaaatccgtgagcggcaccaaaatgatccacaagcgatggctatctttgaagatcatgattttgatgaacatactgagtctgattaccgccgggatgatgaaccggatgcggatgacattgaagacctgtatgagggttaatgtttctggttgttattgatcgcaggcggttactggccgatagaacgattgatagataaaaataaacccgctggctgaatggcgggtttatttatttgctagcgtcggctaaatgagcaggatgatcattccccactgacctcaatgtttcccgcggccttttttgccacttcaatggcggtttctatattatctgcaacggccagtgcaacccctaaacgccgctgaccggcaatttcaggtttaccaaataaccgaatctgtgtatcgcctatcagggcagtttccagcccgcgataggtgatattctggctggtcagttctggcaaaataaccgccgaggcagccgccccatattggcggatagtgccaattggcaaaccaagaaatgcgcgcacgtgcaaggcaaactcggacatattctgcgaaatcaaggtcaccatgccggtatcgtgtgggcgaggagaaacttcgctgaaaataacgtcatcaccacaaacaaacagttctacgccaaataacccaaacccacctaacgcggtgaccacttgtgcggagatctcttttgctcgctgcagggcgatatcactcatggcttggggttgccaggactcgcgatagtcgccatcttcctgacggtggcctattggggcgcaaaaatgaataccatcgacagcacggatcgtcagtaaagtgatttcaaaatcaaaatgaaccaaaccttcgataatcacgcgcccgctaccggcacggccaccttgttgtgcatattcccaagcagcctgaaggtgttcctcgctgcggatcaggctctggcctttaccagaagaactcattaccggtttaacaatgcaagggtaacctatgtcgcgcacggcctgaaagaaggcgctatctgtgtcggcaaagcggtaactggacgtgggtaattgcaacgtctctgcggccagacggcggatgccctcgcggttcatggtcagacgggtggcttctgcacaaggcacaacatgttggcccatcttctccagctcaaccagcatatcggtggcgatagcttcgatttccggcacgatataatgcggtttttcctgggcgactaactgcttgagtgcggcaccatccagcatattaatgacgtggctacgatgagcaacatgcatcgcgggggcatcggcatagcgatcaaccgcaatcacctcaagccctaatctttggcattcaatcgccacttctttacccagctcgcctgcgcccagcaacatgacacgggtagcgccggggcgcagagcggttccaatggttagcatagttagatacctacatctgtgggagattacacgttaatttgacgcgcgccagtatacggcaaaatagcgacgaaaacgattgcgtctgtaatgttaaaggggcgcagcagtgaatttcttctccatacatttctctcatctcataccgccgccctaaatacaaagaagaagttgcgcagcgtctcgcctatttaacctgttttttgcggtttaattccggcaacgcgcctatctctggtattatcgcggcaaaatcttgcgcttgccttcaggccatcgctgccattccatccagttataagagttactgccgtgagcacaacttccttttcttccctgacactgcctgctgagcagttgtccaatcttaatgaacttggctataccgagatgaccccggtacaagctgcggtgttacccgcaatcctcaacgggcaggatgtccgggcgaaggccaaaaccggcagcggtaaaacagccgcatttggcattggtttgctggacaaaatagcggtaggggaatttgttacccaagcgctggtattgtgcccaacccgagaattagcagaccaggtcagtaaagagctgcgccgtttagcacggtttacacaaaatattaaaattctgaccctgtgtggcggccaaccgatgggccaccaattagattctctggtccatgcaccgcacattgtcgtgggtacgccagggcgtattcaggaacatctgcgcaagaaaacgctggtacttgatgagttgaaaacgctggtgttggatgaagctgatcgcatgttggatatgggtttttccgatgccattgatgacgtgattgcgtatacccctccacagcggcaaaccttgttgttctctgccacctacccatcaggtattgagcagatcagtgcacgagttcagcgccaaccattgaatgttgaagtgggtgataccgatgaagagcccgctattgaacaggtgttttttgaaacgactcgtgagaaacggctgccactgctgatctcagttctgagctattaccagccggcctcttgtgtggtgttctgtaacaccaaaaaagattgtcagagcgtttatgagtcactggaatcacgtggtatcagtgtcttggctttgcacggggatttagaacagcgtgatcgtgatcaggttctggtgcgttttgccaatcgtagctgccgtgtgttggtggcgaccgatgttgctgctcgtggtttagatatcaaggatctggagctggtcattaactttgaattggcgtttgatcccgaaattcacgtacaccgcattggccgtaccgggcgcgcagggatgagcggcctggccgttagcctatgtacgccacaggaaatggtacgtgcccataccatcgaagattatctgcaaataaaattgaaatggacacctgcggaacaggttagccgtagcaccaacatcatgctggaaccagaaatggtgacgttatgcattgacggggggcgcaaagctaaaattcgccctggtgacattctcggggcattaaccggtgatgcagggttaaccgccgcagatgtgggtaagattgatatgttcccggttcatgcctatgtggctatccgtaaagccagtgccaagcgtgcgttgcaacaattgcagcaaggcaaaatcaaaggtaaaaactgtaaagcccgtctattaaaataatcattgcggggtgatggcagttgcatcatcccgataaatcaccctatactgtgattatatacagttatctgtgagcgaaaaggatgtatagcaatggccgttgaaataaaattcgtcgtggtgagacagggtgaggaaaaaatgactttcacaaccaaaaaagaagccgatgcctacgataagatgctggatttggctgacaacttgtctgaatggttatcacaggctccgctgtcgctagaggaagaacaacgtgaagcgttaagtttcttcttggcagaaaataaagaagcattagggcaaattctacgcggtagtacccccgtggtcgccgttgatgggccacaaaaagtacaatctgaaaaaaatactgctgagaagaaaagtaaacctgaagaaaatcaagccgcttaatttgctcactttcggcagaaagtgaaaaagagatctaaaatgaatcgtgaaatcaccttttttggccgttttgaagccgatattctggcagatcgtaaaacgattactatccgggatagcagtgagtctgattttcgctcaggggaagtccttcgggtgtgccgtaatgaagatggggtattcttttgccacatcaaggttaaatcggtcacgccggtgacactggacgggctatctgaacgtcatgctgagcaagaaaatatgtcattagacgaactgaaaaaggtgattaaggcgatctatccagggctggatcggttttacgtgattgaatttacgcggtgttaattaaacagtattaatcacatcagtttggttgtgctgttcactttacaacctgtgtttcaatcatcactccagtcactagataggaataataatgtgtggaggagtgatgaaaaagacagggttagctttggtgctggcaaccatactacttggcatgatgggcagcgtacatgcccaagagccgcgagtcgtaaaagttcctgcttgtatcggcttgaatcaatcccaggtagcaactcaggtcaaacgggatttcctacaaaaccgtattcctcgttgggaagcagataaaaaacagttgggcacagataagccggtagtgtggattaatgtggtagatattatcggtaaagatgatatctggcaggttccactgatcgctcggggcaacaagggtgataaaacgtatcaagtggtgctcgactgcaagtctggcacaatgacttatactgggctgaatgctcagaccaggccagatccccagatcggtctgaatagccaagccgggccgaagtaactgccagggccgctgactgttgaggaccaggctcttaatcagttgttattgcagagcaataacccgctatgtttgagggcatattgccctccatctggtcaattcaatagtgtttcaaatggtcaatagtgtttcaaaaggaggccagagtagcctctctggtaactccttgtattactacctaacaataaaaattcccaataatccctttaaatgcccttgtttatcagcaaactatatgtttttctttgcatcaacaggtaatcgtaccactctcgtgataacgcacatagatggataacctaatcaatgatgactcccccaaaagcagataaacgcccttatccgatgacgcgacacggtgatacgcgtgtggatgactattactggctacgtgatgatgaacgtacagatgctgatgtactgaattatttgcaagctgaaaatgctttcacggcggcggtgcttaagccacaacaacagttgcgtgaaaccttgtatcaggaaatggttggccgtattcctccacaagaggagtcagtgccgtatgttcgcaacggctaccgttatcaaacccgttttgagccgggtaacgagtacgctatctatgttcggcaacccgtcagtacagacagcgactgggaaacgctattggatggtaatcagcgtgccgagggccatgagttttataccttaggcggtttagatgtcagtcctgataaccagttactggcggtggcagaagattatctatcacgtcgccaatatgacatcaggataaaaaacctatccagtgggggctggcacgatgaagttatcagtaatacgtcaggcggatttgagtgggcaaatgattcaaaaacgctgtattacgtacgaaaacatgaaaaaacgttattgccttatcaagtgtatcggcatgtggtgggtactgatcctgagcaagataaattaatttatcaggaatcagacgacactttttatgtcagcttggaaaaaaccacgtctgaacgttttattctgattcaccttagcagtacgacgacgtctgagattttgttgctggatgctgatctgcctgagccggtaccgcaggtttttgcgccacgccgtaaagaccatgaatatggtgtagaccactataaacagcacttctatattcgctccaataaagaggggaagaatttcgggctctataaaattgaagacagccaagggtgcagtgactttgccgatgagtctcaatgggcgttactgattgcaccaagaacggacgttatgctggaaggattcagtttattccgcgattggctggtggtcgaagaacgcagtgaagggttgacgcacctacggcaaatccattggtctactggagaagaaaaatccatcacttttgatgatccaacctacgtaacgtggcttgcttacaatccagaaccagaaacggcactgttgcgctatggttactcctcaatgaccacgccaagctccatgtttgagattaatatggacagtggtgagcgccagttactaaagcaacaggaagtaaaggatttcacccctgaaaagtatcgcagtgaacgtatttgggttaccgcatctgatggtgtgaaaataccggtttcgttggtttatcatcgcgactactttgtttctggtagcaatccattattggtgtatgcctatggttcgtacggtagcagtatggatcccgtcttcagcagtagccgtttgagcttattggatcgcggttttgtgtttgctctggcacacattcgtgggggcggagaactggggcagcaatggtatgaagatggcaaattactcaacaaattaaataccttcagcgactttactgatgtaacgaaagccttagtgaacgaaggatatggggatgctcagcgcgtttttgcgatgggaggcagtgccggaggcttgctgatgggcgtcatcgtcaatcaggcccctgaattatataaggcggttgtggcacaggttccctttgttgatgtggtcacgaccatgctggatgagtcgattccactcacgacaggtgaatacgatgagtggggcaaccctaacgataaggtctattacgattatattaagcaatatagcccttacgatcaggttaaagcgcaggattacccgcacatgctggtaacgactgggctgcatgattctcaagtccagtattgggaacccgctaaatgggtcgctaaactgcgtgagatgaagactgatgaccaccaattactgctttacaccgatatggactcgggccatggcggtaaatcaggtcgcttcaaagcttatgaagatattgctttggagtatgcatttattctgtcgttgatttaatgcaatgatgtctttatacccaaaataatgcggcgcgttgcaggaaggcggtaactgagtaggtccccaggagcttaatttattttaagatcaacgacccgtgagtgactggggtgaacgacggtaatcaacacacatgcagttgggcgggggatggggatatatgatctgaagatatcaatatatattatgaaaatatatttcatcctttttccgtcatcgttaaatatgaacaataaaaaacccgccgataatggcgggttaactcacgaaacgaaaaaccccgttaggctgcgctggtagatgatgatttcttagcgcgtttttcagcttttttctctgcgggtgttttcagtggttttttcttcgcattctttttgctgtccattcccttactcatgccttacctctcttgacctgcggttaggtttgtacgcccacccattaaccacgttatcagcgagagttgcaaggagataaaacatcaaagagattaatctattgtttaataaagacattattaaatcttaagaattcttattttcgtttaatagtgcttgtctagccacttaaagtgaggtgagttattgcgctacggtgtaaatatcatccgttgattgaattaaatgggtgactggcatgaatctgaggttttgtcattgaccctgcgggcggtataggttttgataacttaatatctaataacaagcatggaaaaataatggaacaattacgtggactttatcctgcatatgaaccttacgacagtggtttattagacaccggggacgggcatcaaatttattgggagctctgcggcaatccgaagggcaagcccgcgatctttattcacggggggccagggggcgggattgcaccttatcatcggcagctattcaaccctgcaaaatataatgtgatgttatttgatcaacgtggctgtgggcgctctaaaccccatgccagcttggataacaacacgacttggcatctggtggaggatattgaacgtctgcgcaagatggccgggattgaacaatggctggtgtttggcggttcttggggatcgactctggcattggcttatggcgaaacacaccctgaacgtgtcagtgagatggttctgcgtgggatcttcactttacgcaggaaagaactgcattggtactatcaagagggggcctcgcgctttttccccgagaaatggcagcgggtactgtcaattttatccccagaagagcagggcgatgtgatagcggcttatcgtaaacggctgacatcacctgatcgggcaatacagctagaggccgctaaaatatggagtttgtgggaaggcgaaacagtgaccttattaccaactaaaagctcggcttcctttggtgaagagcattttgcactggcgtttgcccggattgaaaatcactatttcacgcatcttggcttcttggacagtgataaccagttgttagacaatgtgacacgtatacggcatatcccagctgtaattattcatggtcgatatgatatggcgtgtcagccacagaacgcctgggatttagcacaggcttggcctgaagctgagctctatatcgttgaaggtgccgggcactcctttgatgagccagggatactgcatcaacttattctagctactgataaatttgctcactgactctacgcatttaaggcgactgactcccgcgggttaaggcctacgggagcatttcacgattacttcactttaggttcatacggcagtcgagataatttttttgactcgatacggtaatgtgccagccgttgtaaaaaatactcgcgtagagcttcgggttgttctctggcgaccatttcagggataacgggcatattgtagcgctctttaaatgcaacacctgaggcggcaaggtcaacgttcatttttgccgtctcttcgtcagaaagctctaccaaattatatcccatttctttctccttcttagaccatcggcgttgatagcgcaaaaggtaatgcagacggtagatattggcaagtcagtaatgttgccaactatagggaatcagtggatgactatcattaaacagactcattctctgatattggaaatattattaagcgatcacaaataccaataggaatcattatctttagtgcttataaaataatgtgaatgattatcatgatgctttggtatttattttcatttaattttattgtttatttacaattagatatcaataagttgaatgatttatgttttttataaataataatgtgaatagagtgtttttattttgtttttatcttggcataatacaccaagttaattatttcttgcccatgtcaaaaagtaagggaattattatgttgaaaaaagaaatggcacaaaaactcaatgagcaactgaatctggagttttactctgcgaatctttatctgcaaatgagtgcttggtgcagcgataaaggttttgaaggtgcggctgcctttttaaaaaagcattctcaagaagaaatgcaacatatggaacgtttgtttgaatatctcagtggaactggctctatgcctgtactgggtacgattacggctccacctgtagattttgtatcattagctgatgtattcaagcttacgtatgaacatgagcaattaattaccactcaaatcaatgagcttgcccatgttgcgatgaccactcatgattactccacattcaatttcctacagtggtatgttgctgaacaacatgaggaagagaaactgttcaaatctattttggataaactggctctggtgggtaatagcggtaattcgttgttcttcgttgataaagatttgaaaacaatggcggcccaaggctacacgtcagcttaaccggtattgagaaaatattcgccgcggtactattattgggtacggcggctttgttgttgcctatccctccccgcgatcctcgccttttcttgtttttctgtttttcactgattctatgctggtagcatttagcttggctatagccactcgacttgctacattcaaatcgttatcatttgtaataacggtaatggagtgagttgaattttcattcctttattggttatatttcaaccacaacttggtttttggcgttttattttgtgtactccctcacaggtagtgcatttgactggaagtgataggggttcatgctgccaatataggatatggttggtagtagacgattcttccccccatcgattaagggacacttatatgtttattcgtaaagtacgctcatcttgccgcatgttgtcggctcttattgtgttatttgttggcctttctagccagcaagcgcttgctcatgcgcatttaaaagcggagaccccggctgcagataccactataaatgctgcacctgaagccttaacgttgggcttctctgagggcattgagctgaacttcagtggtgttaaagtcacggggccggataataatgtggtcaaaaccggtgatcttaaattggatcccgcgaataacacccaactgattttgccgattggccatgctttagctgctggaaaatatcatgtctcatggcacgttgtctcggttgatggccataagacgaaaggcacttacagcttcactgtgaaatagatatgtctttggcgactctattcattctgtgtcgctttctgcactttatggcagtgatgctgatgtttggcatcactgtattcaccgcctttttggcaccagatcgtttctctttgatactaaaaaaacgcctgtcaccgttacttgtctctagtacgctgctagggttgatttctgccgtgggaatcttggctattcaggctggaatgatgggggatggctgggcagacacctaccgactgactgtctggtgggccgtcttagggacgcgatttggtcaggtatggcaatggcacattggcttgtccatcttgagtatgtggatcgtgttgttgggtagcgcgcgaaggtattactggctgatggtcggctgctctacattgttgctcgcgagcctggcttttgcggggcatgcagcgatgtatgatggggtacttggatgggttcaccaaactaaccaagtcatccacctgctcagtgcggggtactggctgggatgtttaccgccgttgcttatttgccttgcatacactcgtgataagggtgccaaacgtgaagcgatcacgacattaattcgattttcgagctgggggcacttggccgttgccctcgtgttggtcactggggtaataaatagccttattatgctgcaagatgccacgctgacgctgacatcaaattatcagatgctcttactgggcaaagtcatattggtggtatttatgcttgctgttgcgctgattaaccgttaccgcattgttccgatgctcaagcaactgcccacgaaagcacatcattggttagttattaatagctgttttgaaatcgtgcttggcgtggcagtgctattgctggtcagtatttttgccacaatggcgccagtatagtgggcaagaataaatgccagttattgccggtgagcttgcatcaactccgcggtatgcgagaaaatcaaaacaattggctaattgagggtaattaagatgaaaggttttgtgctaatgctgtcgctattgatgctttcagctaatgctatggctgccgggaagattatcacggtcagtaaatttgaatttggtaaacagtgggcgtttacccgtgaagaagtgatgttagagtgccgggcaggcaatgctttgtttgtgattaatcctgccacgttagtgcaatatcccctgaatgatattgcgactgaacaaatgaagtctggtcatgtcttagccaagccgttagacgtcttgttactgaacgacagcaataacccagggcagaagatgagtttggaacctttccaacaacgtgcaatggcgctttgccaacagtaaatcatgctagtttaaccacatgaaaattaaagattgtttaaccgtatgtttatttttattcggccaaaactgtaaaattacttaattaatttacatcagtgattatttagttccgctacaaggttggcgaaatgtcggtactcggctacgcttaagaagtgcggctgaataagcctacattaataccaacttttagcgcacggctctctcccaagagccatttccctagaccgaatatcaggaatcgtattcggtctttttttaatttattaattttacttgtatttcttctctccgttcgaaaatatccgaaattgttatagtcggcctaaatctcaacccactcatttttacacaaatccagggacacatgagtcattttcatcgacttgtggccaagccgtttttgggcgaactgatgtgagtgcagcgccggataccatgtggcccgtttctcccgacaatataaaattgccggtggttttaaccaaagcgaaactgggcaattaagcccagcctatttcagtcatacaaccagcgaccagccttggcggactcaataagcatccctatagtgaaatctggaacaggtatgggcgctgtttttttgaatggattgaaagaaaaaggaacgtcagggaagtaatttttaatattgaaattacctctttgtacagagaactctttaaagaagtcattcattaaatcttctatttcaagctcatcaatacttaggtcagtgtctaagtctgtatcaggggtcaaagatactggctttctcttgaacacatagacgccagcataaggccggacaagatcataaattcgttgttcaatatcatctaccatagcttatcgcccccccttgctatcatgttgtagtcacgaattgtacggtaagtgattgctgatacgtcagcagcaataatgatgaggccaagtagggggatcgaacgaccaacaaacggggcgatattacgcaccatcgcttttctcgccgtccatggagtatacccgcctaaccatgtaggtagcgacatcccaaatgggaattttgttttcttaaatacacttcgtgccgctttggaggcgtatgatgtgccttttgttgcacctatgggctttcctcttgttaagagattgcttctacccgaaataatcgcaaccacagccccgaaatcctgcataccaaactggctggcagtattctcacagaaaatcataaatagtagctcactggcttttaaattcggcttgcctgcataaaagtacgtcccgcccagctcttcaactgtatccatagtacatccttgttatcgtgttaattattgcttaaagcccatttgctcttcatcagcatatattgttacctcacatgattaaactagagtggcaagagattcagacaatcctcaaatgacgtccggcagtggctggtcaatctatcaattaacccactgaataatgcgttgttccgagcataagctcacccatttacccgtcatacttcgagttgcatgtgcgttggctgccgtcgttcaccccagtcacttactgatgtaagctcctggggactcgcttcgttgccgccttcctgtaactcgaattatttagggtaatactcgtcatgcatcaagttgcctgtgcgttggttgccgtcgttcaccccagtcacttacttactgattgatagtacatatgcgttggtaacgttgcggcgatgctaactcatttgggtataagcggtaactatatctgccatccctctgactaacacaggaacactcacgctgaacaggaatacctgcagtggctgaagatagcgatcaggaaaaaagtgaagaacctacagccagtaagctggagaaggcgcgtgagaaaggccaaatcccgcgctcgcgtgaattaacctcaatgctgatgcttggggccggtttgactatcctgtggatgtccggtgaatcaatggcccggcaactctcggctatggttgcgcaagggctgcattttgatcacagcatggtcagcaatgacaaacaaatgctgcggcaaattggcatgttattacgccaaacgttgctggcgatgctgccgatttttgccggattagtgatagtcgctttagcggtaccgatgctcttggggggagtgctgttcagtggcgagtcaataaaatttgacctaaaacggatgagtccggtagcgggtttaaaacgcatgttttcctcacaggcgctggctgagttactgaaagccattttgaaggcgacactggttggttgggtcaccgggttattcctttggcataactggcccgacatgatgcgcctgattgccgcgccaccggttgcagcattaggtgatgcgcttcacttgatcattttctgcgggctggtggtggtcttagggctgtcgccaatggtcgggtttgatgtgttttaccagataaccagccatatcaaaaaattacgtatgaccaaacaagatatacgcgacgaatttaaaaatcaggaaggcgacccacatgtgaaagggcgcattcgtcagcagcaacgggcgatggcccgtcgtcggatgatggtcgatgtgcccaaagcggatatcatcgtgactaacccgacacactacgcggtggctttgcaatacaacgaatcaaaaatgagtgcgcctaaggtgttggcgaaaggggcgggtgccgtcgcgctgcgtatccgtgagttaggtgctgaacatcgtattccgctattagaagcgccgccactggcgagggcattattccggcacagtgaggtcggacaacatattcctgccaccctttatgcagcagtcgccgaggtgcttgcctgggtttatcagctgaaacgctggaagcgggaaggcgggcttatcccgaaaaaacctgaacatctgccggtgccggaagcactggattttgcaacagagagtgagacaaagagtgagacagactaatggctaatttggccgccctgctacgtttaccgggcaattttaaagacacacagtggcaaattctcgctgggccaatcctgatcttaatgatcttgtcgatgatgattttgcctctgcctccattcgccttggatttgttgtttacctttaatattgcactttccatcatggtgttactggtggccatgttcacccagcgcacactggattttgccgcctttccgaccatcctgttgttctctactttattgcgtctatcactaaacgtggcttccacgcgtattattctgatggatggccacaccgggggcgcggcggccgggcgagtggttgaggcatttggtcacttcctggttggtggtaattttgccattggtattgtggtctttgtcattttggtggtgatcaactttatggtgatcaccaaaggggctgggcgtattgctgaagtgggtgcccgtttcgttttggatggtatgcccggtaaacagatggcaatcgacgctgatttaaatgccggattgagcggcgaagatgaagcgaaaaaacgccgctctgacgttacgcaagaggctgacttctacggttcgatggacggggccagtaaatttgttcgcggtgatgcggttgctggtttgctgatcatggtgattaacgtggtgggggggctactggtcggcgtgcttcagcacaacatggcttttggtcatgcagcagaaacctataccttgctcaccattggcgatggtttggttgctcaaatccctgcgctggtaatttcgaccgccgcaggggtgattgtcactcgcgtcagtactgatcaagacgttggccagcaaatggtcacccaactgttcaacaacccacgggtgatggtattaagtgccagcgtactgggtctgctgggaatggtgcctgggatgccgaattttgtcttcctactatttaccgcagcattattagccttggcttggcgcttacgtggtaaacaaacacagcagcctgtggcagtagaagcacccgtggtgcaagatcagcaacagggcgcagaggcgacatgggcagatgttcaactggaagatccgctggggatggaagtgggttaccgcttgataccgatggtggatttccagcaaaacggtgaattattgggccgaattcgtagtatccgcaaaaaatttgcgcaagagatgggctacctaccgccagtcgtgcatattcgcgataacctggaattaccccccgctaattatcggatattaatgaaaggggttgaaattggcagtggtgaggcacacccagggcgctggctggcgattaaccccggtaacgccgttggtacattaccgggtgaagccacccacgacccggccttcggtctggcggcggtgtggatagagagtgcgttacgtgagcaggcacaaattcagggctttaccgtcgttgaggccagtacggtggtggcgacgcatttgaaccatgtgctcagccaatatgccaacgagttgttcggccgtcaggaaactcaacagctccttgatcgtgtgacgcaagagatgccaaagttgaccgaagactttatccctggggtggtgacattaaccacgttacataaagttttgcaaaatctgttaatggagcgggtctcgatccgcgacatgcgcaccattattgaaacactggccgaacatgcgccaaaccaggctgatccttacgaattaaccgcgacagtgcgagtggcattagggcgttcaattgcgcagcagtggttccctgggaatggtgaaattcaggttatcgggttggatgctgccttggagcgcttattattacaagctctgcaaggggggagtggcttggagccgggtctggctgatcgtctgctggatcaatccaaacaagcgttgcaacgccaagagatgctaggcgcaccgcctgtattattggttaatcatgcactacgggcattattggcccgcttcttgcgccgtagcttgccgcaaatggtggtgctgtctaacctggaaattggtgataaccgccagattcgtatgacctcgacgataggatccgcctaatgttgattcgggcctcccaccgtgtattgattctattagcggccagcctgttgccgcttaagattaacgccgcatccggttcttgggtagcggataatattggtatcacccagggtctgcgtggggtggtaacgccgtcatccccgttgcaaccgccagttgcactggcgcaggaaaatgcacgtattgtttcagtcggctggcgctatcagttaatgtcaacggccccggacggtttgcaagtgaagttatgcacgccaacccgctgtataccgcttgaagggggcagtgggcagagtgtagggctggcaggggaagccgcagtgaatcaactgacttttgtctactttattgcgggtaaaggccgggtcaacccgccattacaagtgatcagtaatcaggtgttggtcaattatcgttaaccccattttgggtgaacacagaggtagacgtatcatgaacggatacccagcaccatgacttaactgaaagccaatctcttgttttgcaatgcttatttcacactgtttagttcacgatggaaaaaatacaggtgtcatcaaggcaaccatcaggattaatgcggatattgcggagtaacacttcagactgaaagtagaaataaaaaccgcagcagacaactgacaacatcaaatgaagggggcttattctaattgatattatttatatgataatagttcattttgtattttgtttttttgatattctcacctgcttagttacaataaatcaattctatcgctgtatggtatagactgttttattatatattttgaatatttttaatctgcccagtctggttttttaaaaaagtgctatcctcttaatgtctttactaaattagaaaacaagtttcactttcaactattgcatctttaattaatggtcaaggtgatttcaaatgctcgttttgtggccagttatacctcaaataactcaagttgttgagcacagccaacgcacatgcagtttgacgtatgacaggtatgctttatttcatttaaattatgatggttttccagccaatcagtgagtttctcttgataaggaatgcgggaatgtctatgtattttaataaaataatttcatttaatattatttcacgaatagttatttgtatctttttgatatgtggaatgttcatggctggggcttcagaaaaatatgatgctaacgcaccgcaacaggtccagccttattctgtctcttcatctgcatttgaaaatctccatcctaataatgaaatggagagttcaatcaatcccttttccgcatcggatacagaaagaaatgctgcaataatagatcgcgccaataaggagcaggagactgaagcggtgaataagatgataagcaccggggccaggttagctgcatcaggcagggcatctgatgttgctcactcaatggtgggcgatgcggttaatcaagaaatcaaacagtggttaaatcgattcggtacggctcaagttaatctgaattttgacaaaaatttttcgctaaaagaaagctctcttgattggctggctccttggtatgactctgcttcattcctcttttttagtcagttaggtattcgcaataaagacagccgcaacacacttaaccttggcgtcgggatacgtacattggagaacggttggctgtacggacttaatactttttatgataatgatttgaccggccacaaccaccgtatcggtcttggtgccgaggcctggaccgattatttacagttggctgccaatgggtattttcgcctcaatggatggcactcgtcgcgtgatttctccgactataaagagcgcccagccactgggggggatttgcgcgcgaatgcttatttacctgcactcccacaactgggggggaagttgatgtatgagcaatacaccggtgagcgtgttgctttatttggtaaagataatctgcaacgcaacccttatgccgtgactgccgggatcaattacacccccgtgcctctactcactgtcggggtagatcagcgtatggggaaaagcagtaagcatgaaacacagtggaacctccaaatgaactatcgcctgggcgagagttttcagtcgcaacttagcccttcagcggtggcgggaacacgtctactggctgagagccgctataaccttgtcgatcgtaacaataatatcgtgttggagtatcagaaacagcaggtggttaaactgacattatcgccagcaactatctccggcctgccgggtcaggtttatcaggtgaacgcacaagtacaaggggcatctgctgtaagggaaattgtctggagtgatgccgaactgattgccgctggcggcacattaacaccactgagtaccacacaattcaacttggttttaccgccttataaacgcacagcacaagtgagtcgggtaacggacgacctgacagccaacttttattcgcttagtgcgctcgcggttgatcaccaaggaaacagatctaactcattcacattgagcgtcaccgttcagcagcctcagttgacattaacggcggccgtcattggtgatggcgcaccggctaatgggaaaactgcaatcaccgttgagttcaccgttgctgattttgaggggaaacccttagccgggcaggaggtggtgataaccaccaataatggtgcgctaccgaataaaatcacggaaaagacagatgcaaatggcgtcgcgcgcattgcattaaccaatacgacagatggcgtgacggtagtcacagcagaagtggaggggcaacggcaaagtgttgatacccactttgttaagggtactatcgcggcggataaatccactctggctgcggtaccgacatctatcatcgctgatggtctaatggcttcaaccatcacgttggagttgaaggatacctatggggacccgcaggctggcgcgaatgtggcttttgacacaaccttaggcaatatgggcgttatcacggatcacaatgacggcacttatagcgcaccattgaccagtaccacgttgggggtagcaacagtaacggtgaaagtggatggggctgcgttcagtgtgccgagtgtgacggttaatttcacggcagatcctattccagatgctggccgctccagtttcaccgtctccacaccggatatcttggctgatggcacgatgagttccacattatcctttgtccctgtcgataagaatggccattttatcagtgggatgcagggcttgagttttactcaaaacggtgtgccggtgagtattagccccattaccgagcagccagatagctataccgcgacggtggttgggaataccgccggtgatgtcacaatcacgccgcaggttgataccctgatactgagtacattgcagaaaaaaatatccctattcccggtacctacgctgaccggtattctggttaacgggcaaaatttcgctacggataaagggttcccgaaaacgatctttaaaaacgccacattccagttacagatggataacgatgttgctaataatactcagtatgagtggtcgtcgtcattcacacccaatgtatcggttaacgatcagggtcaggtgacgattacctaccaaacctatagcgaagtggctgtgacggcgaaaagtaaaaaattcccaagttattcggtgagttatcggttctacccaaatcggtggatatacgatggcggcacttcgctggtatcgagtctcgaggccagcagacaatgccaaggttcagatatgtctgcggttcttgaatcctcacgtgcaaccaacggaacgcgtgcgcctgacgggacattgtggggcgagtgggggagcttgaccgcgtatagttctgattggcaatctggcgaatattgggtcaaaaagaccagtacggattttgaaaccatgaatatggacaccggcgcgctggtacaagggcctgcatacttggcgttcccgctctgtgcgctggcaatatagtcagatagtcagatagtaataaggacagtttaatgagctgattatttggggggcgaatgggcgttcggcaaccctagattcgccccaaaagcagcaaattcccagaggacaacgccgctcaggttaattgaacggcgttgttttttaaaaggatttgtcgcgataggcgcgaattggcgttaaataccgatcttacggcccagtatattggcacctttagcctgaccatcagggccatagagcgattggccgtggcgggtattcaagactgccaatgcttgattattatgttcaatatgttgttgtagcagtaacccattgtgcaggttgctgtaacgcaggcgttcagtgagttgcaaaagacgctgccaacgttcagctaaagccggcatacgggtataaggcgcttgaatattcgcggtggtctcggtggttatccgggtctgatccaaataggccaaggttgccaatattgaacttttttgttccgttaccccttgcaatacccagccttggatccgcccagagcatagcaattgttgctcttgtgctacgacattcgtcagcgattcgagcagatccaactgctggtccagattggtttgtaaactttccaccaccacgtatccttattacgattaatgattcttaagctcatccgccacgttttttaacagggcatcggctattttaccggtatccatagtcaattgaccgctgcggatagcctgttttaatgtttcgacacgctccacattgatgtcctgactgcccggttgcatcaattttgcctgcgcatcactcaatttaacctcagtaccactgaccggggtttttgtctgggtagcggattgacgcgtttgttgtgctacgtcatggctttcccgtgcttgaacttgtgttactggcgatagcggttgagtgcgatcaatactgctcatggtgttgctccccttatcgcgggattttcgtttatcaacccgcaaaacatgtgtctatttgcaaaagaatggcgggatggtcacttattcattaacctgcaaataacggcttatgttaattatcggcaaaggttaaaaaaactttaacgactataacataatccgaattgtgccatcgtcagccaccgtcccactgactatctgcccagagggcatacgcacccggatcgtctcctgtgcagcgccattgttcatggctttaccattgctgttaacattaaagccatcgccctgcgctaacactggcacgtcctggcccgctttaaccagccacagacggcggagcatgtttcgggtcaacggttgcccggcattgatttgcctttggcttactgcgccttgtgcaaaatgggcatcgagcagggcaccgggtggtaaagtatccaaccggccctgtttcatttgaatatcttgtgcgctgattttttcaccagccgctaatcgacggacggcaaccgcataacgcccactcacctgaacctgtgtttggataaaccgccgcaggccatcacagcgtactgacaaactgatattcccccacggacgggcattggccggtaacgttatttcgggcgcatcacattgtggccactggttctgcggggtttttatcaccaccttgacctggctctctttatccgggtattgctgctggaagaattgattcacctggactgataaatctgtttccaatgcctgatgagccgccaatgtttgctgagccaatatgtgatgggacaataacagcccaagcgccacgataatgatgttctttctttttaccgccatctttttttcatcgccatcacggtcttcctttgttatcagggctttccccagcgtcacactgttcactatgaatgaaaccgcgagttaaaccgccccctatcacatgcacacgagtgtacctctcccttcgcggagttaaggggacaaatagcgacgcattttgcgcttattctggcgataggcttcccggtacgacgtttatgctgtctgctccaaattttaaccttgcggggggactatgctcgacaaactggacggtgctctgcgttttcaacaagaagcgcttaatttgcgtgcacaacggcaggagatcttgtcgtccaatattgcaaatgcggatacacccggctttcaggcacgtgatattgatttctccagtcaactgaaaaaagtgatggagcaagggcgagccaacgggacaggggtgtcgctcagtttaacctcagcccgtcacataccggcaacgacggttcaaccgcctgatctggacctgttgttccgcatcccagatcaacccgcgatggatggcaataccgttgatatggaccgcgaacgtactaactttgccgataatagcctgaaatatcagaccgatctgaccattcttggcggccagattaaagggatgatgtcagtgttacaacaaggataagacgcatgtctttactgaatatttttgatattgccggttcagcattatcagcccagtcgcaacggatgaacgtcagtgccagtaatctggccaacgccgacagtgtgacgggccccgatgggcaaccttaccgcgccaagcaagtggtcttccaggtggctgcgcagccagggcaggaaaccggtggggtgcgggttgctcagatagttgatgatccgtcaccggatcgtttggtgtatcagccgggtaacccgctggcggatgccaaagggtatgtgcggatgccgaacgttgatgtgacgggggaaatggtcaacaccatttctgcatcacgtagctaccaggcaaacgttgaagtcctgaataccaccaaatccctgatgctcaaaacgctgacactgggtcaataacaggagccagcataatggccattaccaattccctgacggaaagtgattacggtattaccggcacgaccgggaccagttccactaccggcagcagtagtcaagatctgcaaaacagcttcctgacgttattagtggcgcagttgaaaaaccaagaccctactaacccaatggaaaacaacgagttgaccacacagttggcgcaaatcaacaccgtgagtggcattgaaaagctgaatacgaccctcggtgctattaccggtcaaattgacagcagccaatctctgtacgccaccagcctgattggtcgaggcgttatggtccctggtaccaatatatttacgggcagcaccgatggcacggtcagcaccacgccttttggcctcgaattgcaacgacctgcggataaagtgaccgccaccattagcgatagcaatggtcaggtggtacggaccattgagatcggtggtttaaacgcaggtgttcactcctttacctgggatggctcactggacgcgggcggtaatgcgccagatggtgcttataccgtagccattactgccagcaatggtggggaatcactggtcgcaacgccgttgaactacgccattgtcaacggtgtaacccgcggcgcggatggctccaaactggacttgggtctggcaggaaccatcacgctggatgaagtgcgccagattttataagtctgttgttaggctttcatagaactgttaggccttcatagaaccgttatgccgccgtagatcaactatgcggtgataaagcagcagacaggacggtaattcacgttagtgaatgaattgaccttcattatcaaaaacagcgtttgatatgtcatcagcgcctaaggtctgtaacagaccccgaatttaacggagaagaaaatgggcttttctcaagcagttagcggtatgaacgcagcatccagtaatctggatgtgatcggtaacaatatcgccaactcggcaacctcaggttttaaagcgggttcagtttctttcgctgatatgtttgcgggttctcagaccggcatgggcgtaaaggtcgcggggattactcaagattttaatgacggtacggccaccaccactaatcgtcgtttggatctggctatcagccagaacggttttttccgtatgcaagacagcagcggcggcatttactatgcccgtaacggccagtttaagctggatgaaaaccgtaatatcgtcaatatgcaaggtctaaatctaacgggttacccggcaacagggacaccaccaacggtacaacagggcgctaacccggtccccctgtctattccgcaggatatgatctccgccaaggcgacgacctccggcaatatggtggccaacctgacctctacccatgatgttatcgcggaagcgacctcaccttttgatcccgataacccagatacctacagctttgtcaataacatgacgacctttgatagcttgggtaaccgccatgaaatcaatgtcttttatgttaaacgtgctgaagatgcgaccgatgggaatacttgggacgtctacaccagggacagtagcgccaaagtgaccgacccagcagacccgaccgatcctgctgctgccgctaaacgtggttcgatggtttttgatagtaacggtgccctgaaaaacgtgacaaacggtacaaatgcaaccagtaccacagacttcacgtttacgatcccgatgggcgtggttaatggtgcgcccgcacaaagtttcgcactgaatgttgcgggcagtaaacagcaaaataccggtgctgacagcattgttgcacagaaccagactggctacgccgccggtgaatttactggcttccagatcaacagtgatggttctgtggtcgggacttattccaaccagcagacccaattgctcggccaaatcgtcatggttaacttctctaacccagaagggctgtcctccgaaggcgataacgtgtggaaagagacgcagtcttccggtaacccgacgctcgggactgccggtagcggtggcttcggcacgttgaccagtggtgcgctggaatcctctaacgtggatttgagtaaagagttggtgaacatgattgtggcgcaacgtaactatcagtccaacgcgcagaccatcaaaacccaagatcagatcttacaaactctggttagcctgcgttaatcgtactgacgggaagagctcatggatcacgcaatatataccgcaatgggggctgcccggcagtctctggagttgcaggccgttaccgccaacaatttggcgaacgcctctacgccaggctttcgtgcgcaattggctgcgatgcgcgcggtacccattgatgggccaagtctggccacccgcacgatggtcaccacatcaactcccggtgtggatatcagccaggggacgatgaatttcagtggtcgcccgctggatgttgccttgcagcaggacggctatctggcggtacaactgcccgatggcagcgaagcctacacgcgcaacggtaatattcagatttctgctaacgggcagatgacggtacagggctacccattgatgggggataacggcccgattgacgtcccgccccaagcagcagtcactattgcggcggatggcactatctcggcgctgaatgccggtgattcaccaaacaccattgcgcaactgggtcagatcaaacgggttcaggcgacggcgggtgaaatgatgcacggcgatgatggcttgttccatttgaccccggagactcagcaggcgcggggcgcgcaattgcccaatgatccgctcgtaaaaatcatgccgggggtactggaaggcagtaacgtgaaagccgttgaagccatgacggacatgattgccaacgcccgcagtttcgaaatgcaaatgaaagtcatccagagcgtggatgaaaacgaacagagcgcgaaccaactgttagcaatgagttaagcgcgcaggcgcagaggaatgactgatgatccgatcattatggattgccaagaccggcttggacgcccaacagacgaatatggatgtgatcgccaataacctggcgaacgtgagcaccaatggctttaaacgtcagcgggcggtctttgaagatttgctgtaccaaaccctgcgtcaaccgggagcacaatcctccgaacagaccaccttaccgtctggtttacagattggtaccggggtgcgtccggtggcgactgaacgtctgcacagtcaggggaacctatcgcaaaccaataacagcaaagatattgctattaaaggtgagggatttttccaggtacaaatgccggatgggaccaacgcctatacccgcgatggctctttccaggttgaccagaatggtcaattagtcactgcaggcggtttccaggtgcaaccggcgatcactattccggctaatgccctgagcatgacggtggggcgagacgggatcgtcagtgtcaccttgcaaggtcaaaccgcgacccagcaagtggggcaactgacgttgaccaccttcatcaacaacagtggcttggaaagtgtcggtgaaaacctgtatcaggaaaccgccagttccggtgcgccgaacgaaaccacacctgggttgaatggtggcgggttgctgtatcagggctatgttgaaacctctaacgtcaatgtggcggaagagttggtcaatatgatccaaacgcaacgtgcttatgaaattaacagtaaagcggtttcaacgtctgatcagatgttgcaaaaactggctcagctgtaaacctgctttcggggggcatcatgccccctgatcgccgcagcataataggtctctgggcaagtttgccaacctcttactggttataggattgataatcaaagatggatagcgcgccgttcagaacgtcaggtggagtgaaagggatgtatttgagaaaaataagtgcgccgttgatgacaatgctgctactcaatggttgcgcgtatattccgcataaaccactggtggatggcaccacgtctgcgcagcccgcaccggccagtgcgccgttgccgaatggctctatttttcagaccgtacagccgatgaattatggctatcaacccctatttgaagaccgtcgcccacgtaatatcggtgacacgctgaccattaccttgcaggaaaatgtcagtgccagcaaaagttcgtcagccaatgccagccgtaatgggaccagctcatttggtgtgacgaccgccccccgctatttggacggattattgggtaatgggcgcgccgatatggaaatcacgggcgacaatacttttggcggcaaggggggggcgaatgccaataacaccttcagcggcacgatcaccgtgacggtcgatcaagtactggctaacggtaacttgcatgtggtgggtgaaaaacagattgctatcaatcaggggaccgaatttattcgcttctctggggtagtcaacccacgcaccatcagcggcagcaatagcgtgacctcaacacaggttgccgatgcgcgcatcgagtatgtggggaatgggtatatcaatgaagcgcaaaccatgggctggttacagcggttcttccttaatgtttcgccgtactaagaagaggcgtcaaaatgcgtaaacagtcacttgtcactctacttatggtcctgctctcgctggtttggctaccggcctcggcggagcgtatccgcgatttggtgaccgttcaaggggtgcgtgataacgcgctgattggttatgggcttgtggttgggctagatggctccggtgaccaaaccatgcaaaccccgtttaccacgcaaagcttgagcaatatgttgtcgcagttggggatcaccgtcccccccggcaccaatatgcaacttaaaaacgtggcggcggtgatggttactgccaagttaccggccttctcccgcgcagggcaaaccattgatgtcgtggtttcctcaatgggtaacgcgaagagtatccgtggtggcacgttgttaatgaccccactgaaaggggtggataatcaggtttacgcgttggcgcagggtaacgtactggttgggggcgcaggtgccgccgccggtggcagcagtgttcaggtgaaccaattggcgggtggccgtatcagcaacggcgcgacgatcgaacgtgaattaccgaccacttttggcaccgatggcatcattaacctgcaattgaatagtgaagatttcacgttggcccagcaagtcagtgatgccattaaccgccagcgcggtttcggttcagcgacagccattgatgcgcgcaccattcaggtgctggtgccacgtggcggcagttcacaggtccgttttctggcggatatccagaacatcccgatcaatgtggatccgggcgacgccaaagtgattatcaactcccggacgggctctgtggtgatgaaccgcaatgtggtgttggactcctgtgcggtggcgcaagggaatctgtcagtggtggtggataaacagaatattgtcagccaaccggatacgccgtttggtggtggtcagaccgtggtgacgccgaatacccaaatttctgttcagcaacagggcggggtcttacagcgggttaatgccagtccaaacctgaataatgtggtccgtgcgctgaattcgttgggggcgacaccaatagatttgatgtccatcttgcaagccatggagagtgctggttgcttgcgggctaaattggaaattatctaatgagtgatttactggcgatgtccggggcggcgtatgacgcccagtcattggaggccctgaaacgggatgcagcacgggatcccgaaggcaatctgaagcaggttgctcagcaggtggaagggatgtttgtgcagatgatgctgaaaagtatgcgtgctgccttaccgcaagacggcgtgatgaacagcgagcagaccaagctttatacctcgctgtacgatcagcaaattgcgcagcaaatgtcggccaaaggattagggctggcggacatgatggttgaacaactttctgggagcacatcggcaagtgaaaccgcgggtacggtgccgatgatgttggataacgaggtgttgcaaagtatgccagcacaggcgttggcgcaagtgatgcgccgggccatccccacgccaccgtccagtagcatggcggcaatatccccaggtaatggcaactttgtggctcggatgtcaattccggcacaaatcgccagccaacaaagtggcattccacatcaactgatcatggcacaggccgcactggaatccggttggggccaacgtgagatcccaactgcggatggcaaaagtagctataacgtttttggcattaaggcgggcagtagctggaatgggccggtcagtgaaatcaccaccactgaatatgagcaaggtgtggcgaagaaaaccaaggcccgtttccgggtgtatggctcttatgtcgaggcggtcagtgattatgtcaaattactgacccagaacccgcgttacgcccatgttgccgccgcacaaagcccagagcagggcgcacatgcactccaaaaagcgggctacgccaccgatccacaatatgcacaaaaattagtcagtgtgattcagcaaatgagaagtaccggtgagcaggcagtgaaggcgtatggggggagtgatttgagccaactcttctaaacctaacgcaataggctattttacttgccattttgggcttgagcagtgcgcggcgccgtcacgtactgggtgtacgctccgttgcctgtgcgctggtcgcacccaaactgtctgcgacaataacgcctattggataagttggatttttacacaataggctattttacttgccgttttgggcttgagcagtgcgcggcgccgtcacgtactgggtgtacgctccgttgcctgtgcgctggtcgcacccaaactgtctgcgacaataacgcctattggataagttggatttttacacaataggctattttacttgccgttttgggcttgagcagtgcgcggcgccgtcacgtactgggtgtacgctccgttgcctgtgcgctggtcgcacccaaactgtctgcgacaataacgcctattggataagttggatttttacacaataggctattttacttgccattttgggcttgagcagtgcgcggcgccgtcacgtactgggtgtacgctccgttgcctgtgcgctggtcgcacccaaactgtctgcgacaataacgcctattaggacaacctcagctattgaataggttggatttttactcaagttttccaataacaggccgatactgattacaggctgtgcgggggcttcggttacctcaggcagtatcccaatatcaataaatgcaggcgctgcgatgctcgtcgcctgctgtaaaaggattgcgtcatgtccaatagtttaatgaatacggcaatgagtggtttgaacgcagcgcaatatgccctgagcaccgtcagtaacaacatcaccaactttcaagtagccggttataaccgccagaacacggtctttgcccaaaatggtggcaccattacctctgccggttttattggtaacggggtaacggtcaccggggttaatcgcgaatataacgcttttattaccaaccaactgcgcgcctctcagacacaaagcagtggcttggccacctattatcagcaaatttcgcaaatcgacaatctgttgtcgaacgcctcgaataatctctccaccaccatgcaggatttcttcagcaacctacaaaacctggtcagtaatgctgatgacgatgctgcgcgcaaaaccgtattgggtaaagccgaggggttagtgaaccaattccagaacgcagataaatatctgcgggatatggatgacggcgttaaccaaaaaattaccgacagcgcgacgcaaattaataactatgccgaacaaatcgctaagttaaacgaccagatcacccgtctgcggggcagcagcggtagcgagcccaatgccttgctcgaccaacgtgaccaactggtgacagagttgaaccagattatggcggttacggtcacccagcaagatggcgatgcttataacgtctcgtttgctggtggcttgtcgctggtacaaggaccgaatgcctataaagtggaagctattccctccagtgcggatgcgacgcgcttaactctgggctacaaacggggtaacggcgaggcaacggaggtagatgagagccgtattactaccgggtcgcttggcggcaccttgaaattccgcagtgaagcactggacagcgcccgtaaccagctaggtcagttggcgttagttatggctgatagcttcaatacgcagcacaacgccgggtttgatatcaatggtgatgagggggaggacttctttagtttcgccgaccctaccgtgctgaaaaatgccaaaaatcagggtaatgccagcatcacggtggaatataaagacacatcgaaagtgaaagccagtgattacaccgtagaatttgatggtactgattggcaggtgacccgtctgtccgataataccaaagtgcaaacgacgcccggagtgaatgctgacggtgatcctacgttggaattcgagggtgtcgctatcaagatcgataacggcacgcccggcccgcaggcgaaagataaatttaccattaagaccgtgagtaacgtggcggccaacttacaggttgctattaccgattccagcaagattgccgctgcgggtagtgccgatggcggtatcagtgacaacaccaatgcgcaggcgttgctggatttgcagagcaaaaagttggtcgaaggtaaaaccaccttgtccggtgcttacgccggtttagtcagtaacgttggtaaccagaccgcgacggctaaaaccaacagcactgcacaggcgaatatcgtcacccaattaaccaccgagcaacagtcaatctctggggtgaatctggatgaagagtacggtgatctacaacgtttccagcaatattatttggcgaatgcacaggtcctgcaagcggcgtctacgttgtttaatgccttgctcagtataagtgactaatttattgtttatattggttaaattattattggcggtgacgatattattgcctgcgagggcaatcatgcgccgcgcttaattcattccaggtttagcgggtatggcttgctgaacgtgttactaaaaggaactgacatcgtgcgtttaagtaccagcatgttgtaccaacaaaatatgcagggcatcaccaatgctcaatcactgtggatgcagaccgggcagcagctctcgaccggtaaacgtgtggtgaatccatccgatgaccccatggctgcgtcgcaagcggtgatggtgtcacaggctgaatctgaaaatagccaatatacattagcgcgcagttttgctcgccaaagttcatcattggaaacgacggtcttggcacaaacaaccagcacgattcagtcaattcaaagtttagttatcagcgccaaaaacgataccttaagtgatgatgaccgtgcctcttatgcaacgcagttacagggtttgaaagatcagttgctgaatcaggccaataccactgatggcaacggtcgctacatctttgctggcttcaaaagtgacaagcctccctttgcggtgagtgacaccggtgaggtgacctacgtaggcggtgatgtcgccattgagcaaaaagtggataccaaccgttcgatgactgccggccatacgggtgccagtgttttcatggcattgaccggcaatgcgaaaccggaacctgacgatgtgaatggtgcgccggttgctgcggaaaaaaatatctttgataccattgatacggtactgaattcattaaaaaccccgctgcaaggagcctctgacgaggtgaaagcgcaggcgcaagccgatctggataaaggtcttcgcgggttatctaactcattgaataatgtcttatcggttcaagcagaaattggggttcaactgcaagagttggataatttagacagcttgggcggtgatcgcaccttaattaacaaacagcagttaagtgatttacaagatgtcgattggacctcggctatctcttcttatgttatgcaacaagcggcgctacaagcctcgtataccaccttcaccaatatgcagggtttgtctctgttccagttgaatacgtaatcggccttaaccccgtagcacacacagcctacggggtcttcgcacgggtcattaacgcacatgccgtcacctcatcagtgactaacacggtggcgtgttggcccttgagggtcgcccggatagcctcgactttattcaaaccgccagccacgcagatccgcactgggatctgatcaatctcatcaatcgtcaatccaatcattctgtcatcaagatggtcataaataggtgcgccagtggcatcaatataacgccccgcaataatagccaccgccccttgttgccggtagggttctaccgcagcgtacgtcacggtattggagctgaaaatagtgctatctgctgcggtattacccacgccgaaaacaattttggtacaggtgttgagtaacgccaactgcggcattaatgcaggttcattacacagcatctctttgatttctggtcgtgaaagcagaaagggcgcatgtaaattaatacaccgggcgcggtagcggtcagcaatatttgaagtgcaaagttcaggggagaactcataggtcgaatgcatgctcccggttatctgaatgaccgttaaatcagccaccggatgccgggtgatcgcgtgagagagcgccaatactgtttgcccccacgaaacccctaaaacgtcatttggtgcgataagtgaagacagtaattgcgagcccgcttcaccgacacgtaatgcggtagggcgctgcccttgatcatcggggataacaatacaacgttctaacccgaactctctcataatggcttgtgctaaacgcatcgacgccaaatgctcatcggaaattttgatttccactattccgcgtaaacgcgcctcattcaaatagttgatcactgtcgcgcgagaaactcccaatatctccgcaatatcactttgtttcagttgatcttcgtagtagagccaggcggcagaaaccatcgggttgaggtgcaaggccgtgcccttagaggattcagtcacccggttcttcatattattggtgtggtttttttccaaaacaatgtcctgaataaggtcagtaacgacagaaagtgatcggcgctatttttttaaaattgtgtctatcagatcaaatttttaacataaaagaaataactcggtagcatctatgccttattcctcttgacggacattacatttgtaaggcatacaaatcatatgtaatgacataagtaactagcatagaacatatgttactacttacgaggtgaagatgaaaagtctttggagtgatgccgatgcggctgagtgtgttgaaaggctaggtttactggggctaccgcccgagttggggcttcgcacttactctgcacgcttgttagggtcgaaccccaagcttgtcttacacggagggggaaatacctcggttaagctcaatatgaatgatcttttcggtaaccccgtacaggtgatgtgtattaaaggtagcggccaagacttagccacaatcaccgcgtcaggtcacccggcggtcagattggcaccgctgcaacaactgaaggtattggatcatctgtctgatgaagacatggtcaatatcttacgcacgaatcttctcgactgccgtgcgccgaccccctcggttgaagcacttttacatgcgtttgttgaccggcctgttattgatcatacccatgcggttgctgccatggtcattgctgatcaacctgatggtgaccgtttgtgccgccacatctatggtgagcgtgtgctgtggatcccctatgtcatgtctggatttgcgctctcactcgcggtcgaacgtgccttccgagcgtacccggatgcggagggtatgctcttgggtaagcatggcctgtgtacgtttggtgagagtgccaaagcctcttatgagcgaatgattacgtttgtcaccctggctgaaaattttattgaaagccgccgggccatatattccccgccagtgataacgccccccgcaaagcccaacaattcggctgacatggcacacattgcgccgtatctacgtgctgcttttgctcgttcaagtgcgataagtgaaaaaaaacattggatattcgatttacgtactgacccaaagagtctcgcgttttcatctggcttaggaacctcagacattgcccagcgtggcgtggcgaccccagatcatgttatccgcatgaaaggccgcccggtggttttagatgcgcctgacctgaataatttgggcgactgggccgcacagacacagacaaaaatcgcggcgtttgttgagcgctatcagcactattttcatcgtaataatgcccggtttgagagggggaaaatagcactggacgccctaccaagagccattgtcattccgtatctcggggtggtgggggtgggcagaaccgcagaggacgcggcaatcaacgccgatatcatcgagtcatggctggacgtcgtgacggatgccactgtctgtggtgattatgagccgattggtgaagcggacgaattcgacatggaatattggtctttggagcaagcgaagatcgacaaagcgtcggtaaaaccattacaagggcagatcgtggtggtcacgggggcggggggcggtattggcgcggctatcgccaaggagttttcgttattaggggcagaactcgcggtactcgatattgatagcgaatcagccaaaaacgttgccgcgcaattaggaccacatgcactggctttacagtgcgatgtcaccgagaccgcttctgttcaggcggcttttgagatgatagcaaccaaatttggcggcgttgatatcgtggtatccaatgcgggcgttgcgttatccggggcgatagctgaactgccggaagccacactgcgtaccagctttgaagtgaacttttttgcccatcaacgggtggcccaacaggcggtcagcatcatgaaaaaacagggtatcggtggggtgctgctgtttaacatttctaaacaagcgatcaaccctggtattaactttggcgcttatggcacctcaaaggccgccttgttaagtctggtgcggcaatatgcgttggaacagggtcaggatggcatccgagttaatgcagttaatgcggatcgtattcggtctggtttacttgatgatgaaatgattagcctgagggccagggcgcgcggcctgagcgaagagaagtacatggcgggtaatttacttggtcaagaggtcaccgctcaagatgtcgccaaggcttttgtcgtctcggccatgctcgataaatcaaccggtaacgtcatcaccgtggatggtggcaatgtcgcagcgatgttgcgataaatcatggttttccttcgttcaggtttttaccgatataaatcctgaggggagcactgatcaggagcctcaaaccgttatcgtgattcaaaccgttaccgtaattcaaacagtatgggggttcaaactgttatgaaagttcaaacacgaatgggctgcaaacaattaactcgccgtatgttgaacgataagcaacttaacttcttggtcatggtcaatatgttggttattacggtggccgctacccttacccaaggggcctttgtcgatctctacaatctacaaacgatggcggggcaggtccctgaattgggcttgctggcgatgggggtcatgctggccatgatcgtgggtaatggggggattgatctctcgggtatcgctctcgctaatctggcggcggtagtcgccggcacgctcacaccggggtgggtcaatgctgttgatagccctttgctgtttaccgtggtttttgtcttatgcgccttgttggtcggtctgaccggggggctaatcaatggggtgctcattgcttacgctaaactcacgccgatcctctgcaccttaggcactcaacttattttcaccggctttgctgtcgtgatttctcatggtagcggcgttaagattggttttattgaaccgctgtcctttattggtgatggccttattgccaatattccgttctgttttgcgctgtttatcctcctcgccacgttgttaggtctttggttacgttttagtgcgaccgggatacggctatatctcttgggaaccaatcttaaagctgcacagtatattggcattgcgcaacaacggttgctggtcgtcatctataccttatcaggcactttagccgctatcgccggcattattattgccgcccgttctaccagcgctaccgccgattacggtagctcttatgtgttgattgctattttgatcgctgtgatggctggggtccgcccagaggggggatatgggcgaatgggctgcctattgctatcggctaccgccctccagtttctttccagtacctttacttttctggacgtctccagttttttccgcgactgcgcttggggcgcgttgctgctgttcttcattattttttcccgcattaatcccttggattttgttaaatcgttatggcgaaaaaataccccgtcagtgcaatcccccgtgcgctgatgagcggtgttcctgggggaaatcaactgaggaaacaccattatgatgattaaaaagttgtgtctcattgccgccctcgtattcagcctcgggatcatgggggcttatgctcaacggagccaatcgattgttactgtcgttaaagttattggtgaaccttggtatacccgcatgggggaaggggctaaagagtttggtgatgaaaatccgagcatcagtacccgcacggtcggccctgcaagggccgattccgccttacagctgcgcatcgttgaagacttgatcgccaaaaaagtggatgcgttggccgttgcccccatggatccgagcacactcgaaggtgcgcttaagaaggcaatgagtcggggcatcatcgtcgtgaccaacgaagcctatgacatggtcaatatgcacgcggatattgaagcggtcgataacgccacgtttggcgcaaaaatgaatgaggggctggttaactgtatgggcgaaagcggtaagtggaccacctttgtcggttcactcggcaccaataaccatgtgctttgggccaaaagtgccgcagttaatgcccaaaaataccccaatatgacgctggtggatccattgaatgaatcctttaatgatgcgaatagagcttatgacaaagccaaagaaattatgcgcaaatatccggatatcaaagggtttcaggggcattcggccattgatgttatcggcattggtcgagcggtagaagaggccggtctgcaaggcaagatatgcgtctttgggatcggcctgccgcaagactctggcaagtatctggacagtggtgcgatcaacggcatcagtttctgggatcctaaagatgccagcctggcgatggataccgtcgccaagcttctgctcgataaaaaacccctcactgatgggatgaatctgggggtgccgggctatgagaacgtcgccatcaggaaaggaaaaggtgacggtgttttggttatcggtgatgcggcaaagtttgttgataagaccaactggcagcaatatccattctgatgagtgggaccaatcataaacgatgccgcttaagtggcacggggcgtgttgatggaggatcacccatggacgtttccatagaccaacgcgccatggcggcgcaagaaagtcaggagggcgctttcctcgtcatacacaacgtgcataaacgctacaatggcgtgcacgcactgcggggaattaacgttgagattcatcaaggtgagatttatcacttactgggtgagaacggctgtggaaaaagcacgttaatcaaggtgatctccggggctattggcgcggatgaaggtgagttggtgatcaatggcacggttcatcagcaattaacccccattgaggcgctgtcattggggattgagacggtttatcaggatctctctcttatcccgaatttaagtgttgtcgagaatattggattaaccgaacaacttgtcgcacaggcaggaagattaaaccgaatactggatcgccagcgcctgttgtccaccgctaaagcggcattagcggtggtgggcttaccttccaacgagcgttttttgttcaccacggtagaggtgctaccgatggcacaacggcaactggtggcaattgctcgagccatcgccactaaggccagactggttatcatggatgaacctaccacgtcactgacaaagaaggagattgataacctgattggtgtcattcgtcagcttggtcaacaacatgtcgccgtgctgtttgtgagccacaaactggatgaatgttttgccattggcggccaagtcttggtgttgaaagatggtcagaaaatcgctcaaggtgccatcacccatttcacccagtctcaattaggctatttaatgaccgggcgacagatggatgaacgacgttaccgtcgtgtacagcaggggggagagccgctgctaacggttacggcgttaggtcaacaggcggcttttgacgagatatccttcgtgttacaccgcggtgaaattttaggtgtaaccggatcacttgattcagggcgcaatgaactcggtttggcgttagccggaatattgccggcaaaccgtgggagcatcgctctcgaaggtcagccgattcatcttaggcaacctcgtgatgccattaacaaccacattgcttatgtgccagaagatcgtcttgatgcgggcctcttcctcggtaaatcgatacttgagaacctcattgcactcgaactggatcacttactgggctattgggggcaagtggataaggggcaatgcctggttttagccacccagacgatcctcgatttagatatctctgcaccgaatatcaacctgccggttcaggcactttctggtggcaaccaacaacgggtcctcattggcagagcactgaccatcaagccgtgggtgcttatcttgcatggccccaccgtcggcgtggatgtcggcgctaaagatacgatttatcggctgatccaaacgctggcgcagcaagggatgggggtcatcctgatcagtgatgacctaccggagctgtgtcaaaactgcgacccaatcctggtgatgaagaaaggccgtatttgccaacaggtgagcgcagtggatgccaatgaaaatagactctatcaagcacagatcgccgatgagggactcactgaggatttatagctatggttattgatctccccgctcacccgaagccatcacgctcattcaacgccatcatcgcatggtgcctacagcggccgtcgacctttacctttatgttgatcgttatcgtgtgtgtcaccgtcggtgctattaatcctgcttttttacaactctccaatctgtttgatattgcgagagcctcggtcgtggtgggtctgtttgcattgggcgtcttgattgtactcgcctccggtggactggatgtctcgtttacggcgattgcggcactgtgcatgtacgccgtcacgaagtttgtcttgtggtattggcctgatgccccggttatcgccatgtttattgccagtgcctgtgggggggccatcttgggagggattaacggtgttttggtccacagcctaaaaacctcatcgcttattgtgactattggcacccaatacctgtatcggggggggctgctgacgtttattggcacggcgttatacatgaatattcccgagcaattagagcaatttggtaaaagcccgctctataccgtcagcaataacaatcaaggcatcacgatactgccgctgttctttttaatactggtgtttgccagcttactgacctggtggttactgaaccgcaccttgctgggccgggccatttttgccattggtggtaatagcgatattgcccaacggctcggttttgatgtgcgcggggtacagatctttgtatttacctacgccgggttgctggcggggatcgcgggcatggtgcatgtagccagtaaccgcatcgctaacccgtttgatttaaatggcctggagttaacggtcattgctgctgtcattctcgggggcgcacgtattaccggcggcagtggtacggttttgggcaccctcatgggggtggtcttggtggtgttggtgaacaacgttttaattctggtgggtattccaagtacatggcagaaggtgattatcggggcgtttattatcgccgccggtagcgcctttggttggcgtaagtatcgctaaggccgatttcagcatttatgtttaatcaatgatgatgaggatatcaatatgtcaaaaattgtcagcctggggattcatgttcttgatgtattaggacgtcacgtgaaccgattcccccccggtggagagctcgatattattaatgaaatccgcttaaccgttgcgggtacagcggctgggatgagtgttgatctggctaagctcggcggcgatgtttatgcgatgggggccgtgggtctggatgaatcgggcaactttattatcgacaccttgcggcgctatggggttaataccgaccacattgtacgtaaatcagaggtacaaacctcttgcagtatgctgcccatcagacccaatggcgagcggccggttctgcatgttttgggggccaacgcggcctataggcttgaagatatccattgggatgtgattgccagtgcggatattctccactttggtggcacttatttactgcccggccttgatgggccacccacggccactatcttaaaattcgccaaagagcatggggtgactaccacgctggatttactggttaacgcccaacctgacctgctggccaaactggagcccgcgttgccttatatcgattattttatgcccggtttagatgaggcgcgggccatttgcggtttagataaacgtgctgatgttattgcgtttttcctgaaccgcggggtgggccatacggttttcaaaatgggggctgaggggagcagtattgcgtcactggacatggcggaggttctgatccccgcgtataaagcgcaggttgtggattcaaccggctgcggtgattcctattgtgcggcctttattatggggttaaccaaaggctgggatctggcgacatcggggcgcttcgcttctgctgcggcctcgctggtggtctctggtttaggctctgatgcggggattattgattttgagcatacccttaaggtgatgaatacggccgaaaccttacccattgcccaagagacttaaccctcggatcccaatgatggtctatcgttcgggtcattgggatagctcggttttttttatcttgattaagggtaaactactttttcccttgggtaaaagacccctttaatacagttgggatttagtacagcgatttggatatggtttttttcataaaatttagcgccttcatacaaaggattaccttctaaaaaagcggctctaacagagtcgaatggttttccttctttttttgcaagagtgtgggcatatcgaataaccgcacaatctaattctctacatctaaaatcaaaatcgctgttaccaaattttttattcaccggtatttctttcttttgcgaatttaatgatccaagcatttcttcaaatgagaatttcagaaaatcaatatgcttttgatcaaataagtctaaacaattaccaaggtcaataatagcgcctaatacaaatggtttttttattctcgagttttttcttgctttatcttcaatagcatattgaatggctctttcataattgttttcccaaaaataaacaccattgccaagccaatcatatgaattattactgtgtttgaagttgtctttttttaatagaatgggtaatgctgcatcttcatccattccatggaaaccatatatgatacttggttttgataagtacattctacatccctattccttgggtttacttttttcaacagtttcttttgtaaaaaaacgagaattgtaagttccattttttgttaatatttttgactcaacaagtagttgaaatcgctcttccggggtgcgattttttgctgatttttttgctctttttaataattcatccatatccataatggcaccttttttatatttcacatactatatttaaggttgatttatgtaacattgtagtttgatttacgtacaaactcaagtggtcagtatttaatggtttttcacccattattattctctaccgaattacccctaaggattatcatcactcattgggctatatattctgaagttaaatatgtaatatcaggatgaatggttcttcagatagggggacgtctttacttactctgcctattctctccatcgcgagcacgttatcatcaattttagccgtccaaagggaccgctatcagtttgccatgccgcttaatacctcggccaggcggtcgaagaattcaccaaacaggtgttcggtgaaaggggctaacaatggcatgatcaaacccaaagagataatacctacggtcagtgttaacgggaaaccaataacgaaaacagagagttgtggcgtcatccggttcaacatccccaaggccatattcaaggttaacaacagggtaatcaaggggagagccagcatcagcccattcataaagatcatcgaacctgactgggccagcgtgagaaaaccgttgccattaaggggggcaaattgaatgggtaaagtatggaaactgtctgctaacaatgaaatgagccataagtgaccatcaaaagagaggaagagcagcgtcaccaggatgttaagcaagcgggataataccggcatgtttggcccacctgaagggtcaaagaaggtggcgaaagataaccccatttgtaacccaatcacctctccggataaccgaacggcggcaaaggcgaattgcatcgtcacacccagagcaacaccaatcaatatttgttggatggcgacccagagtgcagcgctggagaataaagggatattcaccgggggcagggagggcgcaatcagaaaggtaattaagacccccagcccaatcttcacttttttgttgatctgtttctcactcaacagcggggcggtgccgatcagggccaatacccggaccaacggccaaaagtattggctaacccagacgctgagttggtgggtatcaaaggacagcatggctagccaatcaacgtgggcaggctggtgaataaattgcgcatatagtccaggatcaagttcagcatccacgggcctgcaatcaccatagtggtgaagaccgccagtattttagggatgaatgacagggtcatttcgttgatctgtgttgctgcctgtagcaggctgacaattagcccgctgatgagcgcggccagtaacagtggcgcagccaatgccaaggcgatcttcattgcctcggtaccgagagccattactgattctggagtcatgacgtgtctgcctcttgcctaactgtgggagtgaatacgcgataagccagtgacgggagagcacccaccatcaacgcacctgtaacgtgaaatataccgggttaatcagctataaaaactctgtgccagtgaacccagtaacaattgccagccatcaaccagaacaaatagcatcagcttgaacggtagcgagatactggcaggcggaaccatcatcatccccagcgccatcagcacactggcgaccaccaaatcgataatcaggaacggaataaatacggtaaaaccaatttggaatgccgttttcaactcactggtgacataggcgggcagcagaatacgcatcggaaccatttcggggccttccagcggcggcaggtttgccaaccgggcatacagcgccagatcagattcccgcgtttggcgcagcataaactcccgcaacggttgtgagcctttatccaacgccacgtccatgctgattttatcctgactgaagggcagataagcctcttgatacactttgtcaaacaccggtgacataataaaaaaggtcagaaacagtgccagccccagcatcacctgattcggcggggccgaaggggtgcccatcgcgttacgcagtaacccgagcacaataatgatgcgggtaaaactggtcatcatcagtaacgccgcgggcaaaaaactcagcgtggtgatgaacaccagcgtttgcacgggtaaagaccaactctgtccaccattagccaacggttggctgatgatcccaggcagttgagccaataccgaaggcgagcaaaataaggtgagcagccccagtgtggttttattgataaccgacattattatggtgcgccacatccggcagaacagcgcgccagtgatgagagaacgtttgctaataaaaacagggcgatgggacgtcatgccgatttttccggatgtttcaatattttgttcagcagttggcgaaaatcagccgcttgcgcattgcttgttgatcgtatgccatccgcctgtcgcggtgcctcaaccaccggacgcgccagtgtatgcaagggggtaacctgttgggccgtaacgcccaatactagccaggtgtcatcgacttcgacaatcaccacccgctcacgttgcccaacctgacaactggcccgcatgttcagtagcttgctattacgggcctgtggggcaaaccccaaccgccgcaccagccaggccacaaacagaatcaataacagaataccgcccagcgcactgcccacctgcgttaacaccccccctgcaggcatggccgggggggcggcgcttgattgcggttgcagttgactgctcggctgtaactgactgttcgaccccggatgactggcagcaaaccctgtggttgcggtttgctgtgttgttgtcgaggccaatgctgttgaggccaatgctgttgaggccaatgttgttgaagccaacgttgttgaggccaatgttgtcgaggccagtattgtcgaggccggtgcggctgcagtcattagcggctcaaacgacgcatacgttcagatggcgtaatgatgtccgtgatgcggaccccgtatttatcggccactaccaccacttcgccctgagcaatcagataaccgttaatcaaaatatccaggggttcgcctgccaaaccatcaagggagaccaccgagccttgtgacaggcgcagtaactctttgatggtcattttggtgcgacctaattcaacggagagttttaccggaatatccagaattaaatcgatatcctgcaaattacccagcccctcaggtgcttccagcgatttaaagacgccttcggttgtggccgtgggtttttctgttgcttgctgctcattaaacgcatcagcccacagatcgtccacggattcctttccatcagcagacggaaacttagggtcactcatttgggctgttcctcactcagagcattcaaaatagggttaatcaaatgttcaacacgcagggcatattgcccgtttaatgtcccgtattgactggttagtaccggtacgccatcgacgtgaccaatcagtcggtccggtttctctatcggtaacacatcccccggctgtagttttaggatctgtgacaatcgcagagggatatcaacaaaattagccaccaattccagctccgaatgctgaacttgcttcactaaggtttcgcgccagtagttatcttcctgacgggagttctccagcggtggattggtcaacagttcgcgcaagggctcgatcatggcgaagggaatacagatattaaactcaccgctcagggtgcctatctccacctgaaaaggcgtgctcaccacgatgtcattgggggaggtggtgatattggtaaatttcacctgtatttctgagcgaacatattccacatcgattttatagatggccgcccaggcatcacggtaagcatccaacgccagccgcaacatccgggtgataacccgttgctcggtatgggtaaattcacggccttccactttcgttggaaaacggccatccccgccaaacaggttatcgaccgcaataaacaccaaactgggggcaaacacgaatagcgcagtaccgcgtagcggttttagatgcaccagattaaggttggttggcactggcagattgcgggcaaaatcatgataaggctgaatttttatcgggccgaccgtgatgtctgggctacggcgcaataggttaaacaaccccatacggaactggcgggcaaaacgctcgttgattatctccaatgcgtgcaggcgttcacgcaccacacgtcgctgggtcgtcggatcgtaaggtttgacgtctgtctcattggcggtgattaccacgggttcttcactcccgctatcgccatttaacagtgcatcaatctctgcttgtgaaagaatgctatcgcccataatgattatcgcaatatgaatgcggtaaacagcacatcgctgatcacctgattaggttggcctttaaccattggcgggctaagtatgtttttaatgtcattgactaaacgctgtttgccttcttcattcgataagctatcggctgactgacgagaaagcagtagcagcaagcggctgcgaacttccggcagatagtcattgagtttggtgcgggtggtatcgtcgggcaatcttagggttaaaccgatataaagtacgcgatccagattattatcgggcgtgatcaaattaacggtgaaggtctccaacggcataaataccgggatggcagcaacaatctgggtattggtcggtttactcttatgaagtaaccaccagctatagccgccacccgcactggcagctatcgcaaccagcaccagcaggatcagccagatcgaactcttacgcttggccgggaaggtattatcagacatggggaagacaaattcctgtttcgatattaatcggtgaatcacgataataacctggggcaatgcctgtgctgatggccaccaaccgcggtccacccacaaaccaccccacgcgatacgaattattgctgacgattatcccgcttatctgcaataccaataggcagaataggtgggaaaaaacggcctagcttgcccgtttgttcacttatggtgaaacaaacgtcagttttaggcgaagacatcagttttaggcgaagacatcagttttaggcaaagacgttaaccttaggcgaagacatcaacaccgccttgaccgttcgctaaggattgtaaggcggttggcgcggccaacggggtctcggtcagaggaccggcgaccacatcaccgtaagtgggttggccgcgagcaatgacgtcctgctgattttgctggctttgctgctgtgcctgctgccattgcccctcgctgccaacactgctttggcctaattgaaccccactttccgccaaggcgtggcgtagactgggcatcgcggcttcaagtgcggcgcgtacctggctgtgggcagaggcaaagtgcaattgcgcttggttatcttccattttcagactgatctgcaaggcacccagctcttgtggatgcaaacgtaactcggcactttgctgaccattacggctgaacatgatcacttgctgccctaatgactgttgccactcctggctgcctagcggggcacttaaatacccgttggcgggggcgctgaccagcgaactggcggcggcggtgttcatcgggctggacagcgcagcggttactggcgttaaatttaactgtgttttatcgctgctggcggaggagagagagacctcgctctgggcagccaatggtaggtttttggtattgaggccgctctcgccgtcctgcgccgctaaatgggttaatttgtccggtgcgggagtggttttaccgttagtggccccggccagtcgctctgtgcccgtcagcgccgtagcatctcgtttcgctgtactgtttttgtcgcttattaacccagggtgacttattaactcatggtgacttattaacccatttttacccatcaactcattattgttagccagcaacttctctttagagagcgagtttgcttgctcggcgctgccagaagccagcttgtcagcgccgagtgtcgccgcgacctgatgcggcaacatggttaataaggtttgtagcgcgttgacgtcacgcttctcgtcgccgttgtccggttgcgcatcatcattagccgtggttttttttacgccagcggcatcaccgacgagcccgagatgagtcagaccggcaggcagggtggcggtgatatcccccagtgcggccagcaactgattgagtttactgctgctactggttaatttgccactgtcggtatcagtggtggctgcggctaaagacgatttcagcattgctgcctctttagccgtcagttccttacccggttgagtgagctgatcacctaataacttcgcgaaatccgttggcataccggcatcgctaaacagcgttgcaatagaggaagaagacgaaacaccttcgctttcactcggggtcgccgcagcgggcaatagggacagattcataaattaagactcctttgtgaggcgcgctgagcgaactcatccatcaatttttgatctaaacggttctcttgctggcgctgagtggtttctgcccgctcttgcaaggtttcaaacgcgtttaaccgctgctgtttctcttgccaatacttcactgcctgctcaactttgatactccattgagccagttgtttgcggtgttgatcgatagcttgttccagcgtttgaataaactgctgataattttgccaactggatgaagccatcccattgcacagcgtgtcattcaaccgctcccggtattcatcctgataagtcagcaacatagtcagttgctgctcagcattctgataggattgacgcacgtgtcccagttgagtactggcctgttcgacggctttctgggccagatcgcacaaggtgacgagaggtgactgacttttcatcgaattcctcattggttacaggggcgacacggcgatttgcgtcatcctttccggctgctcagccttaataacgtcttagccgggaaataaacccttcaaatgctggcaggcatcgtcaaaactgctgcgctcaaacatgccttgctgcaagaaagcctccatctgcgggtacagggcaatcgctttgtccaataagggatcactgcccgcagcataagccccgacactgaccaaatcgcggttacgctgataactggcaagcagttgtttaaactggcgcacccggctgtaatggtcatcatcgattaacgaggtcatggcacggctgatagaggcttcgatatcgatagccggatagtgaccggattcagccaaacggcgagatagcaccacatggccatcgaggatggcgcgcgcagagtcagcaataggatcttgctgatcatcaccttcggtgaggacggtataaaatgcggtaatggagccgccgcctgaaacaccgttacccgcccgttcaaccagtgccggtaatttggcgaagacggagggcgggtagcctttggtcgcgggaggctcgccgatagccagcgcgatttcacgttgcgccatggcatagcgggttagggagtccataattagcaacacatgctgaccacgatcgcggaaatcttcggcaatacgggtggcataggcggcaccttgcatacgcagcaacggtgacacatcggctggcgcggcgataaccaccgaacgggcgcggccttcagccccgagaatattttcgataaaatctttgacttcacggccacgctcaccaatcagcccaaccacgatcacgtcagcctgtgtgtaacgggccatcatgccgagcagtacgcttttgccaaccccagagccagcaaacagccccatccgctggccgcgcccgaccgtcaacaaggcgttaatggtacgcacgcccacatccaagacttggacaatggcggtgcgttgcaaagggtttatcggtggtgtaatcagtggtgcacgataaccggtttcaggtgccggtaagccatcaagcggtttggcactgccatccaatacccggcccaataactcggggccaaggggtaattgtttactggcgaatgattgtttactgggaattgattgtttactagcagacgtgccgctggtggtgactcgggcatacactctggcaccggggacgataccttccacatcttccaaaggcataagaaacagatgctgaccgttaaaaccaaccacttcgctttcgacttcctgcacttcaccgccattatggcgctcaatcagacaggtcgcccctaacggcaattgcagaccagtggcttccagcactaaaccggtggcgcgggtcaagcggccataacggcggattgttgtcgtttggctgatacgctcttcgaatttatctaaagaggtaagccagcggctgaggcggggggtcatcacagttcccccggcgcggccagacggcacagttcatgccaacgggtcgccagactggcatccaaatcgccttcttccgcgctgactttacagccgccagcatgaatctggctgtcgcccaataagcgccagccgtgcaagctcagcgtggaacctaaccgctgttcaacaatggctaaatcatctggatttacccgtaattgcgttttgcccgcaaacatcggttcttgctggatcatctgctggatttgcgccaagagggccgtaccatcacaaatcgcgggttgtccgataatttgtttcgccgcggccagcgctatttgtactaagcgtgaggcgatgacgctatccaaggtatcgagcgtattttgaaaatcggtcaccataacttgccagtgggcggtcattggtgccaattgctgctgcgcatcggccagcgcttgctggtggccttcttccagcccggtttggtaacccttatccaacccttcttgcaagcctttggcaaacccctgctggcggccctgcttctcggcttccaattgcaggtttaccaacacctgttgctcatcaacggcggctgtggcttccatcggttcattaggaaataacagactgatatccggcatagactcggacagtggtacctcggattggctggcaaaatctttcagggaccaaggttgccagggcagggcgttaatccgatcagacatagatatcctcgccgccgccaatcacaatttcgccgctttcggccaaacgacgcacgataagcaagatggatttctgttcgttttcgaccagtgacatccgcaccggtccacgggtagccagatcgtcgcgcagaatttctgctgcccgcagggacatattgctgaggaagcgctcgcgcaaggcctggtcggcccctttcaacgcaatcagcaacgattcgttgtcgatctcttgcagtaaacgctgaatgctacggtcatcaacactgaccaaattctcgaacaggaacatttcatcgataattttctgcgccaactcaccatcgtattcacgtaccgcatccataacggtttcttcctgttgtgttttcatcaggttgataatctctgcggctgtacgaatcccgcccattttgctgcgtttgagattttggccatcaagcaggttatttaacacttcggtcaattcagccagcgcggcaggctggacaccgccaaaggtggcgatacgcagcatgacatcgttacgcaggcgctcatcgaacagggccagaatatcggcggcctgagcacgttttagatgaaccagaatggtggcgataatctgtggatgctcgtcgcggatcagatccgccgccatctgcggttccataaagttgagggtttccatcccactggtggtttcgcgagattcgagaatgtcttccaacaaactggaggcgcgctcttctcccagggcttttatcaatacgctacgcagatagtcgctggcgttaacactcagtgcagcatattgctctgcatcatcttcaaactccgccaagacatcgaccaattgctgatgagaaacctgacgcatactggccatggtggtactgagttgctgcacctcacgggaggagaggtgcttgaaaacctctgcggcgtggtcttcacccaacgtcattagcataatggcgctcttttcagttccggtcaggctcattggtcattactcatccattgacggatcaccaacgccacaacacgtgggtctttatccgccagttcgcgtatacgctgggcctgaacttcagcactcacccgctgctgattcttcttacgcagggccagctcttctttactttgttttactgtctcagccgcttgtgcggtttgaacgatgttattgaccgaggcggccgctttatctgcaacctgttttttggcgagcattgggcgaagtagtttgcgccacaaaatccaggcaaccagtaggatcagcaggtagcggccggcattcagcaactgatcaaagaaggattgctgttgccaaaacggtaggctgctgccacgggtatcgtcactggctgtgaagggggtattgactacgttcagtgtgtcaccacggacggtagagaaacccatcgcctcacgggtcagtgactccacctgcgccaactgatctttactcagtgcaatcggtttaccggctttatcgctggtgtagttcaccaccaccgcgacggataaacgctgcaccatacctgcttgctgctgggtatggcggatggtgcggtcaacttcgaagtttgtcgtttggtcatggcgactattgctggaactggctttcgcggcggttgctgtcgtatttgcgttagccgttgtcgccgcattagccggagcggcattattggcggcggcccctgccggttgtgggatttcaatcggggctatcggtgccactggcggttggttcgataacgcccccggcacaccgcctacgttggttccgcccagttgttcgctggtactcacctgttgagagcggacagcaccttggttggcggcctgattcggtttgtactcttcatccgtttgttcacggctggcaaaatcaacctgcgcagtcacctgagcatgaacattaccgttgccgaccatcggtgccagaatattttcaatacggcgctgataacggttttcgacttcgctggtgaatttcaattgcgaagcatttaaatcgcggcctgcactgtctgattgcgtcaacagacggcccgtttggtcaaccacggtgacgttacccggcggcaagcctgccacgctactggaaaccatataaacgatggcattgatctggccatcatctaatgcgcgacctggttgtaaggcgagggtgaccgaggcggtcggggatttttgttcacggacaaataacgagggtttgggcatcgccaaatgcactcgtacattcaatactggcccgagtgtgccgatggtccgggataattcaccttccaatgcccgctggtaatttatctgctcactgaattgactgatgccgaatttttcctgatccagcaattcaaaacccacagcgccacctttcggtaaaccctgttgtgccaaccgcaagcgggtttcatgcactttctcagcggggatcagcaatgcgccaccattatcagcgaaacgataagggatgttcagttgtgtcagttgggtgacgatatcaccgccgtcacgatcactgagattgctgtaaaggacgcgataatccgggcttttagcccagagcatcaaggcgacaatgatagcgatagcagcagccgcagcaatcagcagggggattttggggttcgcgcgtaggcgtgccagtgtcatcgtaaaagtgttctcacgattttcaccgccagttatcgaggcattcatacacgtccttgcccaagctgaacaacgtttgaattaatattcttcatataaatagtgtgctgaaacaaaacagactcccaggtgctgtgagcggtaccgcatcaatagctgttcatcccttattatgggcatgccattatttgctggaagtgaacaattcgatggctcaataagccggtatttttgtatctaattagccgctttagcgcaaaaatgatgtgttagggtgtcatcctgaaaagagtgatacgtgcgtgcttgcggttaagaatgaaagtgtttaaacaccttcgtggataaaaaccgcccagacgtatgcattgctcgcggtgtttataacctgagggtgaatatgtctgttcaaggtatcgaaggggttttacagcagttacaagtgaccgcattacaggcctcggggtcagcaaaaaacctgcccgcagaggcgggcttcgccagtgaactgaaagcggcaattggcaaaatcagtgaaaaccaacaagttgcccggacgtcggcacagaattttgaactgggtgttcccggtgttggtttgaatgatgtgatggttaatgcgcaaaagtcctcggtttcgttacagctcggtattcaggtgcgtaataaactggttgccgcctaccaagaagtcatgaatatgggtgtgtgagtcagtcagattattaattttaatgaaaaatatgataattaccctggcacacaattaccctggcacacaattaccctggcacacaattaccctggcacacaattaccttggcatacgattaccttgacacacaattaccttgacacacaattaccttgacacattgtgagctggctggaaggtgatttacggacaatccaaccacgtagtgactttccgctaatcggccgccagtttgtattagggcatacccattgttggggcttgataatgccctacttcaggcaaacacatgacattgagttgaaaaactatcgtgtaggccgacattaatgggagtccggtgcagaaaacaacatgcagttgattagatatagcttgagctatacactatgtatcaacaagaatggttacaacccattcacaactgctgaaaattcaatgtgtcagcggttttctatctataattcagagggtaacgtaatgagccatgcactgaaaaatgcagatcgcttatacattccacctcgtgacaagggcacgaaggcctatccacgtgcatctatggatacaagtagcactcatgcagatcaggtcaaaaatgcatttgcgtttggcttttctcgctatgaaaaagcaatggaagaactttctaaggtgtaaatagacgcctatggcagatattgttgaagggatacattatctttctgttgaagatttcatctacataaacagaacgttaattgaggctcaaacccctagcgagccaattgatgtcattaatcacaacaatctctgttcctcacaagcaagacccagcgtagtaaaatactatcagcagacagacgatatgttcgaactgtctgctgctctcatcgagagcttaatccagaatcacgcctttgcaaatgctaacaaacgaacagctatgatggctggatatatgtttttgttgcttaacggatatgaactcactgcacctggcgacgagattgtggtaatggcagaggggatggccagaaggtttataactgcgaagacctagagaattggctctgctactggtctaggccgtatgactcacgaaacttatgtgattgtgagatatcttctctagtagtgactgcaacacaggtaaagatagaataatgttcgtatgagatatcaacccacttagctgtgggtttttgcgttatcttgccgctatcccctactatgatgtttccacttgtaaatggtggggatagggatatagaaccgtggggtaaaaaatcactgttaattcattcgaacgtaaattgctcaataagactaatggcttactgcgtgattgatcaatcctccagcgttttgtgtgacaacgcccataaataaagagaggcagttgttccgtatggggtatatcggcggcgatagcgctcgaaacgctcacggggcagggttttatggcgatataaattcatcatgccgcggcggatggctaaatctccccaactgacaatatctggccgtgacaatgaggagatcaacagcatttccgctgtccaaacccctacgccgtcaagacgtgaaagctgtgtaataacctcgttatcaggcaattgcgcaataacagataaatccagcgaaccattaatggccgcatcggccgcccctttaatataacccgctttcctcatggtcataccacagcgttgaatcgcctcggcggaggcagcggcaacggtggcgggggtgatgctacccaataatagggttaagcgtgtattaacggtttgcgccgctttaactgaaatttgctgatcaacaatatttctgatcaatgcagcgaataagtccggcgataatgggcgctctaacatccccaaacgctcaatagctgcggccatttttttatcccgccgtttcagatgatttatttctgtttcgccgtaggtatagaacaccagcccactccttcctgcaactcgaattatttggggtaatagaaaagcgatagaaaaatgacagataaaatacgtactgaccaggaggccggtagcgattaagcatagcgtgaacggctcgttattatcctctgattcttgctctttttagtcaatatttttaggccgattcaggcagcgagacagattgataaccgactctttgcagcagaatagtgatatcaatactatcgactttctcggcgtgtaaataagccgcagcatagtcatgccagatacctgattgcagaaataagataaacagttcccgatccagatggctttcattcaccatactcaccatgatattaagggcttctgataacatttttcccgatttataaggccgatcggctgcggtgagtgcctcgaaaacatcagctatggccatcatacggacaggaatactcatttggctacgggtgagctgataaggataacctttaccatccatacgctcatgatggccgccagcaataacggggacattcgccatggaacgagggaatggcagctttttgagcatcacaatggtctgcataatatgctcattaatcttatagcgatcttcttcggtaagcgtaccgcgtcgaatacagagattgtaaatttcccctcggttataaaggaaggttggttctttaactttaaaatcatcatattctgaacgtttatttttattatctcgataaataatatgctcttctttatccgctaacatgggctcttgcacaggtaaggcgctgattggttgcctgtctttgcgtactcgctcttcatttgaaatgcctgcggtatcatccaaggttctggtccaatgatagcgggcaatatgctggatccgggctatcgcctcatcagacataaattcgccaccgacattgcaatgagcgataaaatagaaatcatcatctaactggtgtaattcatcagacagttgttgttgctcagcctcattggcgataatcgtgcgatgacgacgtaagaaagcaatttctttttcacgttttagcacttcaaacctcatgcgtatttcgtgaatacggtcatagattaactctaatttggtcgatttatcgacgacaaactctggcgtggttattttgccgcaatcatgtaaccagcaagcggtatgcagttcttcccactcatcctcagataaattaaagtcggcgaatggcccttctttactctccatcgctgctctggcgagcatttttgttatttcaggtacgcgctggcagtgccctccggtataggcactcttggcatctattgctccggcaataagctcaataaaggcattgagcagatttttttgttcttgcagcaagcgctgagtttctactgaaatagataagctgcccactaaagcattaaccagttgaatttttgaacgttcacgtgctgcatttaactcataagggttgaataacagcaaaaaacctaacaattgatcatcatgggttcgcatggggacggcgacaaagcgcagcggtaagtaagggtgcaaaaaatcgcgcaattggctgagtatattttctttatttaacgttcccgtaatggttttcccttccagtacaggattaaaaatattgaagttatcttcattaacctgcaacgatggcatccctgatactgggatattttcactgttccaacgaaaggcggttggggtaaatgtccccacctctttatcggccaaaaatataattccaccggtcatggaggcgatttcggttgtctcactcagtagcccctgcatttgacggaaaaaattgctttctgaggtcagcatattgcccattgaaataaattgcttcagagtcagtttcattttagacattgatttatgtagctcatcgacttcctcaatagctgaatgttctaattcattctcctcaaaatgcagatgactgatggcatcagcatcttgtcgtaagcgaataaggggtttagatattcttagtgagaaataccagataataggcaaactgagcattaatagaataaaagcaattaatgttgagcggttacggatagcatttgcctctgccgtcagataggccgctggggtggcaataaccagttgatactggttaccattattattgatatcaacaatagagccataccaagactgatcctgtgcctcaaatataacactgctattatggcctttagtgtgacggccatcggcggggggggctggagagtcgattaatgcctgtaatatcggtacttgtttacctgtaataggactctgtgccgcttcattttttttcttcggtagactggcgatcacttcatcgcgggagttaataataatcgcctggctgcctggtggtaggttttgtttagctaaaaattgagataacgaggctaaagaaacatccaatccaatgatcgcctgtttattctccgcacgacgactataggtaaagcctatttcgcccgtccctttgaaaatatagttcggtgaggtgttcagtgatgcattttgtgacgctaaaataaaccaatctcgccgtcgggggtcgtagccatcattatctcgcagcatgacagcaataatcttttggtcgtgattgagataaataaatcgcttctcaggcaggctatcaagatagcgattactttgaatcatccactccgcgttttcaggcgcgtgaaatagcacccggttagcctcggtcattggccgcaacataaaaaaatccccattggggtaagcgctgtatacggcactggcatagttattctgctgtaggatctcaataaatttatcaataaaactaatgcgttgctcaagggtcggcaattcggtgatttgcatactggcaagaatattgactgacatcatcatcgggcgagtaatagcctctaactcggcggcaatggcctcaccggttttttggtactgttgatgagtgctaatttcagtgagtttagtcaactggttgtggttataaataataataaccgtgccgattgagacaatcaggagcgtaaagagaacagcaatttgaatgtgcaaaggatagcggctttttaatccgaaccagttactgaacataatagcagccccgacagtctattttttaatcgtgcttaataataggctttgcaacaacaattgctatatctctctaaatttcagcaatttagacttaacatcatgatttcaaatgttttaatcgatagcgtgcgaatattaccggatgaatacgctaatggcggccttaaaaagaacgctttaaagcgcaaaatatctaaaagcagtctttagccactctcattattgttagcaaggcagggagtggttgagtttatgggaatgaattgcatgaatgatataaattaagggggattgaacggcggaataaataggcatgaaggcaaccttcaaacgccttatgttgcaataaatcaggaatatgagggcttaaggtaacgattaactgagtgtatcggtgattcactctctaccggttgcaagcgatggtggccgcgaatagcggttggtgcaaaaccaaagcgcttacgaaaacgttcggcaaaacgtgatgaactttcataaccgatttgattggcaatcaatgagatcggccaatccgtgccttgtaataggcgaagtgcactggtcatgcgaacatcgatcattaaatcacgtaagagtatattttctgctgctaactttcgccgtaataccacttcactcattgtcatgtgttcggctacttcagaagcggaccatatcttgtgtggatcgctggccaagcagcggcgcactttttcactcaagccgttaccgtcatttaatataaatttaacatcacgctgcgccagccaaagtaataactcaagcatacggtgcttgatgattaccgttggaatatcactattttctgatattgagttaaatatattgccaaacgtattaatgaattcaggtgctaaattacggattgccatcacgccgggaataacccccaaatctgctgaagtagggtgatgagcaaaggccgcgatcaaactcgggtcacaatgaagttgttgactgaagaacaggtcatcattagatagcccattaataatatcaatagtttgcccgctatttataactgcaatttcgcccggcaggataacgcattcctggttttcccaacggataattttatacccacgattaaccataatgagcaacgggtgctcaatatagactgaagtgagaagcaactcggaatgttgaataatatgcgctgcgctacccacaccgggacagaaactgattttatgtttcatcaatatttatttcatagtttgacttgataatatttttacgctttgaatagcaggctggcaaactattttaataaaaaacttaccatagcaagccacttcgactataaagcacgctatttcgatgataaaaaacatcagagcgataatagcattcaatacgacatgagtgaatgctgttaacacgatggcaacattcagcggaacggatatataccctaaataattcgagttattgaatgtagccaacgtacatgcagcttgaaatattacaggtataacatgacgttgataccccgtattttattgtgtttcacccagcagcagtgcctgatcggggaactgaccataagtacgattaaccgcctgttggcgggtagattgccccaccaattcacttaatttatctaaacgacgttgcagtaaccgcttaatttctatctcattctccaatatggatctcaatttttggcgcagtaattcttgcaatactggcgatgaacaagaggaaatagtgatattagctgtattttcaacggctttgagataagccatttccagatcaaccagcgcatcccagttttccacagtagccaacataagcatttgctcactgagagttaggatttgttgatattcggacaaaagatgctggtgacgttccattaaatgggtcctaattgggttgataattcgggccgatctgccgccacgcatctgcaatattttcgagcaaggcagacacttcattaattgcctgttcgtcattatgcaaattagcgtacagtaagcgccgcgacatatagtcatataaggctgataaattttcagctatttcgccgcctttctccaaattaagccccgcactcaggccgttattaataatatcaattgctttggatattgcggcacctttagcgggaatattaccctggctcatcaaaatacgtgcgcgaatcagggcgctttgcgccccatcgaacagcatcacgatcaattggtgtgggctggcactcattacgccactttccaggcctacctgtgcgtaagcctgacttccagatcgcttatacatgtcttatcccttatgattcaaattgttgtgttaagaaactggctgtactgttcattgatgtcatcagcttatccaattgagtaaattgtgttttatagcgctcaatggctgtttctatactggcagtcgttgccgcaatttgtttatccaggttttttagtgaagtattaataccgtcagtggctgtttttaatgtccctaatgtcgtatccaatgcggtattgagcaacttttcagtctgagtagcaaaaccagtagtttccccatcacccacaaaaaatgcagtgacgctattgggtttatcggtgagtgcagtatttaatttatcggcgtcgataaccaacttaccgtcgagatcttgcgtgatcccgatgctggctaaggttttcaaatccccagattgactagaggccaattggctctttaattgcgtctggatagagcgcaatgtgccatccccaactaatgcaccattactcgtggattgatcttggcctgtctctaccacggtatatttggtcagtgagccgaaggtggtttgtaatgagttataggcatcgacaaaactttggatcgccgcctttgtggctgtgttgtcacggacaatagtcagttgctctggcgcgccctctttggtgacggctttcagattgatggtgacgccctgaggtgcatcggtaatggtattactttggcgggtaatactgacaccattaacactcaaggtggcgtcttccgctttgactttttgcgtcagcgcaccactaccgccggtgctgctgggggtatagttcaggaaattatttaaggtttcatcacccgctacactgatggtcatttctgattgcgtaccggtatccttcgacgttaatgccagataataagtattatcatctgctttcataatactggcgttgacactgccttcctgcttattaatagcatcacggatacccgtcagcgaagtttgctcgctggtcaggctgattttcatcggctctttttggccgggttgagcaatcgtgattgtgcgtgttgcatcactgctacccaatttatctgtagcgctaggcacatctgtcgataacagcgattgtgctttggccagattggtgacttcaatactgtacgtacctgcactggccgcactatccgttgtcgcgctgaatgcggaattgctgccgctgactgccgtagaattcaacgtgtcagcttttttcagggcggtagacgcggtttcaagctttgccaacgcactttgcaaaacaccataagcggtaagtttgcttttataactggtttgctgcgtggttagcggggtaaggcgtgtctgctctgcggccgataattgtgacagcaatgtatttaaatccagtcctgaaccggtacctagtgcactgatacttgccatgtctaatcctcaatattcaagtgtcgatactctgttatcggtcagaaagctgaaaagtttacacaaagagtaggaataatgatggctggaatagcaggggataatagggggctatttgctctattgaataggtcgataatatagagaagagatcagaataatcttcagcgaattttaaaattattttgttgaatggctaaaggttccttaaagagcgccgatacaagttgtgacggtgatgacgccgtgggcagtaagcccaaatcataacccaacagcatttaaggaataatactatggcggtaattaacacaaacagcttgtccctgctgactcagaacaacttgaataaatctcagtcttctttaggcaccgccattgagcgtttgtcttccggtttgcgtatcaacagtgcaaaagacgatgccgctggtcaggcgattgctaaccgtttcacctctaacatcaaaggcctgactcaggctgcacgtaacgccaacgacggtatctctatcgctcagactactgaaggttctctgaacgaaatcaacaacaacttgcagcgtgtacgtgaactgactgtacaggcgcaaaacggttcgaactcaagttctgacctggactctattcaggatgaaatcagcctgcgtttggctgaaattgaccgtgtatctgatcagacccaattcaacggtaaaaaagtcctggctgaaaacaccacaatgtcgattcaggttggtgcaaatgatggcgagaccattgatatcaacctgcaaaaaatcgactctaagagcctgggcttaggtagctactctgttagcggtgtatctggtgcattaacctcattaactgatacatcagtaacaggtgtaactaccacgaccgcgcttgattttagcgacattagcacttttgctaaaggtgccacagtacatggtattggggacgtcggcacagatggcgcttatgcagacggttatgttatccgtactactgacggtaaacaatataaaggtgaagtagatgctactaatggaaaagtaacatttgcagatgatgctaatggcgatccaattgatgatgctaccaagctggaagctgcggctcagtttagtcctgctggcaaagcaacggcttcaccattggagactttggatgatgctatcaaacaagttgatggccttcgtagttcactgggtgcggtacaaaaccgtttcgaatctgcggtcaccaacctgaataacaccgtgactaacctgacttctgcccgtagccgtatcgaagatgctgattacgcgactgaagtgtctaacatgagccgtgctcagatcctgcaacaagcagggacttctgtgttgtctcaagctaaccaagttccacagactgttctgtctctgctgaattaattcgccagcattcatacccttatcccaaccctgctccggcggggtttttacctcagtttgtttgagattgtcgtggtattagcagctttcacaccgatggcgctggggatctatcaccctatggaaatgattcaagggttatttccatagggaacagataaaaatcagacgctgagaatgcgcttcaagggtatctcagccaatttatcgctctaccgacaaggggttaacagtaaaaaccatggcataagccaaatagccgcccttttataggtctattccggcgattggctgacttacctgacaggataatggaacgactctcttacccttaggtgcctgtctcgtgagtgatttgtataccgccgaaggcgtgatggataagaattccctctggaaacgctatgttcctttggttcgccatgaagcattgcgtctacaggtgcgtctacccgccagcgtggagttggacgatttattgcaggctggggggattggcctgctgaatgctgtcgagcgctatgatgctttacaaggcaccgcgtttactacgtatgcggtacagcgcatacggggggcgatgcttgatgaactgcgtagccgtgattgggcacctcgcagtgtgcgccgtaatgcacgggaagtggccagtgccatgcagcaagtcgaacagcgagtagggcgtccggcgaccgaacaggaagtcgcgcaggttcttgatattggcttggttgagtaccgccagatcctgttggacaccaacaatagccaacttttctcctacgacgaatggcgtgaagagcacggcgaaagtgtcgaacccctgttggaagggcatgaagatgccaatccactaaaacacttgttggaaggtaatctgcgtcagcgcgtgattgaagcgatagaggcgttgccagaacgcgaaaaaatggtgcttacgttgtattaccaggaagagctgaatttgaaagaaattggtgcggtgcttgaagttggggagtcccgcgtcagtcaacttcatagccaagcgataaaacgcttacgcgcccgcctaaataacgacgcttaattcacgttcaatctgcttccctgcggggtagtcacccggatgactgacgcgtagttagcgttactggaataggttcattgggatgatgagcctattcagcggctcaccctgcgggccagcacaagcgccattaaaaatggctaacccctttgtcattggtttgttgcctacctacaacgccaatgattgggggcatatatcacgttgtcttactttattaatacaggccttctaatgtcaggactccagttaaaaaagcggccgctgagccgttatttaaaagattataaacacagccaaacgcattgctcacattgtcagaaacagcttgatcgcatggtgttagtttttcgcgggcaaatcatcaataaagagaccatcgccggcatggaccaacctatcgacgatccgctttggttaaaacttcaggaagaactgacggcgctgtgccgcttttgtagtgagatatactgtaataattcgctcggctatttcgatatcatgccgtttaaacaatatttatttgagcaaaccgagatgagtcacagcactgttcgtgaatatgttgtgcgtttgcgccgtttagatgaaatgcttgtcgcgactaattatcctgcagaaaagtttgccactgaagcattgtaccagcgcattattgatgatattcccaatgcggctcataataactaccgcattgctttgcgtaaatatgatcagtatttggcatggcaaaagaactattgagtctggttgcatcgcgaagtcactagggtataggtatagagagtcaatctcttatccacatcaacgatagccattatttcttcacgcctggcaaatcctccctccaccaggcgtctacgttctcctgccgtccagctatttccgtcaaacgattctcgttaagttattcccattaagctatcccctgcgatattggtcactgacatcactcataaaatcagtgcttattaatgtcacatctgataaatctatataaaagccatgattcatcaattccttggggggcacgtgacgcttcaacacaaactgacgcaattcccgcgtctcgatctggtcggtaatgcgacgccattagaaaagctgtctcgtctatctgattatctgggacgtgaaatttacattaaacgtgatgatgtcacgcctgtggcgcttggcgggaataaactgcgcaagctagaattcttagccgcagatgccttgagacagggagccgatacgctggttacggctggtgctattcaatctaatcatgtccgccaaaccgccgccgtggccgcgaaactggggctgcattgcgttgcgctgttggaaaaccccattggtactgagcaggcaaactatctgaccaatgggaaccggctgttactggacctattcaatgttgatgttgtgatgtgtgaggcattgaacgatccaaatcagcaattagcagaattggctacccgcgtggaagcgcagggtttccgcccatatgtggtaccgattggcggttctaatgccttgggcgcgctgggttatgtgcagtgctcactggaaattgctgctcaagccgcgggcaatgttgcgtttagttcggtcgtcgtggcctctggcagtgcgggaacacatgcaggattggcggttggtctacagcagttgttacccgatgcggaattaatcggtgtgacggtatcacgtagtgccgatgaacagcggcctaaagtggcacagattcaacaagcgttggcgacatcattagggatgacggacccattggcaaaaatcaccttgtgggatagttattttgccccgcaatatgggatgccaaacgaagaggggatagcggctattaagctcttggcaagactggaaggaatattgttggaccctgtgtataccggtaaggcgatggcgggcttacttgatggtattgaacagcaaaaattctgcgacaaagggccaattttatttatccacactggcggggcacctgcgctgtttgcttatcatccgcaggtgtagcctaagctttcattattacttattccatttttaactatatttatcattttatatttcttcacttcattaatagcactggtaaagtgttgaatatcaaaaataaacatgacagtcggagtctttatgagcttttcaattgtacgtcgccgcattgttctgggcatggtggcggtcgcactggcaaccggcttgaacgtgaagtcttacgctgctggtgacctgttggagcaggttaaacaacgcggcaccctgattgttgggttagaggggacttatccgccgttcagttttcagggcgaggatggcaaactcactggttttgaagtggattttgccaacgcattggctgaacacatgggggtcaaagctaaaatcacgccaaccaaatgggatgggatgctggcctcgctggagtctaaacgtattgatgtggccattaaccaggtcactatctcagatgaacgtaagaaaaaatatgacttctcaacaccttataccgtttctggtattcaagtactgaccaaaaaaggtaacgaaggccagtttactaagccagaagatttacagggtaagaaggttggcgtgggtttaggcagtaactatgagcagtggttacgtgaaaacctgaaagacgttgatattcgcacctatgatgatgacccaacgaaatatcaggatctgcgtgttggccgtaccgacgccattttggttgaccgcttagcggcattggatttggtgaagaaaactaacgatgcactggcggtggctggccccgcgtttgcacgccaagaatcgggtgtggcgatgcgcaaaaataaccctgaattgttagccgcagtcaataatgctattgctgagatgcaaaaagacggcacgctagccaagatttctgagaaatactttggtgcggacgtgactcaataatgccagaaagtatgcaattggtgctggattcagcaccatttttattgaagggtgcctggctaacgctccaactgagtcttggggggatgtttctcgggctgctcttagggtttatgctagcgatgatgcggttatcgcacttctggcctttttcacttatttcccgcttttatgtctctatcttccgtggtacgccactgattgctcagttattcatgatttactatggcctgcctcagtttggcattgaactggatccgatgcctgcggccttgattggtttatcgctgaatactgccgcttatacttcagaaacattgcgggcggcgatttcatctattgagaaagggcagtgggaagcggcagccagtatcggcatgacacgctggcaggcactgtatcgtgttattttgccacaggcagggcgcaccgccttgcccccactgggcaacagctttattggcttggtaaaggatacctctctggccgcgaccatccaggttccggagcttttccgtcaagcacaattgatcacatcacgtacgatggaagttttcactatgtatctggcggcatcgttgatctactggataatggcaacactgttatcggcattacaaaatcggctggaagcacatgttaatcgccaggatcaggagtaaccatgagtaccattgatattaaaaaattgaccaagcagtttaagggtcaacaggtgctacacggtatcgatcttgaagtgaatagcggtgaagtggtggcgattattggccctagcgggtcaggaaaaaccactttattacgttgtatcaatctactggagatccccgattcagggataattcgggtaggcaatattgagattaatggcagcatccacatcagcaagcagcaacgtcaggtccgtgccttgcggcaacaagtggggtttgtctttcagggtttcaatttgttcccccatcgcacggtgctggaaaatatcattgaagggcccgtgattgttaagggtgaagtgcggggttcggcagaaaagcgcggccgtgagttgctggcaaaggtaggattaagtggtaaagaggatacctatccgcgccgtttatctggtgggcaacaacaacgggtcgcaatagcgcgtgcgttggcaatgcagcctcaggttatcctgtttgatgaacctacctctgcattggatcccgagctggtgggtgaagtactcagtaccatacgtgcgttagccgaagagaaacgcacaatggttattgtgacccatgaaatgagctttgcccgcgatgtggcagacagggctatttttatggaccacgggcagattgttgagcaaggcccggcgaaagcactgttttcccacccgcagcatgaccgtaccaaacagttccttgataaattcctgaataacccagactgctgacaaaccccgatgacgcgatcttgaacggtgaggataggcagaggagtaaagcgtccgcgccaaggatggcgcggctcgagcctacatggatgtatttacggcgtctttacgatctgcctgttctctccgtcgcgggcactttgtcaataacctcaaccactgatccagtggttttcggtggcaaaatttaatatgttttggccttttaatatattgaagccttttaatataccaaagggcatttttaatatgttgggggccacggtatggtccccaatttgctagataattttacaaaaatgcttcaagtttgaggcgatgcgctattgttcttacttctttcatgcggccatgcccaggtaatattttttgttcaacagtgaccaacccggctttctttagaatagcgacatcacgggttaccgtgctgcgatcccgctttaaccgggtagacagtgacgtaatagagcccggatacatttttactgtccgtagcagaacaatacgagcagcacttaataccctgaccatctccagagggtcttcaaaggtaatggtatgttcttctggcagtgattttcctgcatctgcgagcgttgcgagttgttgaccccgtgtaaaaaaatcatcttctgttgccgttttgataactaacttgctcattaacttctccttagcgcagtccaatccttctgaaagcaactctctatgtgttcaaagctgacaaaatcaatcgcttctaccccgccgagataatggcggtgatggaagccatgtgcattgtcataaccgatcactcgcccgttatcaccttttgataagtggtgattgatataagccaaattataacgggtaattatgccgcatgagttggcccagatttcacggcgtaactggccgttacctcgccggttagcaattttatggacttcatcgataatttttttatcagccatggttattattaccacctctgttggttgttgtacacagttcattcactaagaaaaaatccaagagtaaaaagggtatttatttctgttgaattaataatgggttagccataaacactgggcaagcactcagcatcagctctgcgggaggcgactgaaagagatggaggatatctgcagccttacatttgataatgcgaagcatctcgaggggttgaacgcttgtctgatttttactttacatctcggtgctggggaaagagactacggctcaaggttgggggctgataagtgaatcggttcataaacatatcgatttataaacatgtcgatttataaacatatcgatttataaacaaggcaagagcaggtgataaagatcaaggtaagtggctataagagtgagtggttaagataaggcgggcaattgtcatcggggtgttggttggcaaaaggccccgaagggccttaattgataaaccgtccaactttatggggtcagttcagtgtggagtggctttcgttttgacagaaataaatctagccgatagtcatcagactggcgttgccaccagcggcagctgtattgacactcaatgaatgctcaattaataagcgttccagcaggatattggtttcaccacgagcgaagccttgtacagagacaatggggccatcaatttgcgcaacctgctcacatagcgtgcgtagttgatccgcatcgccgtgatagataacggcatcgaaggtgatgttagcggtttgccaatcgtgggtaagggtgatccgcgattgcacttcagtaggcaattgaggcaacagtgctttctgtacgtcattctccggccatagaacctggctcccggtcgccaacaccgcagccaactgcgtaagagtatcgctttcggtatcggcaagacaaaggactcgctcacgaggcagcagggcataggtattgcgctcaccggtcgggcctggcaataaccgcacggttccaccttgtgccagagaggcatagcgttggcagagagtggccagcgaatcatgttgttgttccgtggcccattgagtgaacgcgcggtgagcggtcagcagcgcttcacggcctgcaacattttgttgctgttcgccatcctgatgcgccagggtattggccagtgcgtcgtctgggcggctactcagcaggcgatacaaatacaatgggccgccagctttgggaccggtacctgataacccctcgccaccaaaaggttgtacaccgacaacggcaccgaccatattacggttaacgtagaggttgcctacttttgctttttcagtgacacgggcgatggtttcatcaatacgggtgtggatgcccaaggttaagccatagccagatgcattaatttgatcgactaactcattaagatgctgacgctggaagcgtacaacatgtagcactgggccaaaaacttctttttgcagctcatcaaaactgtccaattcaatcaaggtcggtttgataaatgttccacgttgccactctttctcatccaagctgttggtacgggctgcctgataaactttacgccctttggctcgcatcgcttggatatggcgctcaatgccagttttcgcttcggcgtcgataacgggaccaatatccgtagacaggcgttctggattgcccatccggcattccgccatggcaccacgcaacatttgcagcgtatgttcagcgacatcatcctgaatgcagagaatacgcagggcagaacaacgctggcctgcactgtcaaaggcagaggcgacaacatcggtcacaacttgttcagtcagtgccgaggagtcaacaatcatcgcattcaggccaccggtttccgcgatcagcggtgttggacgcccctgtggatcaagacggcctgcgatactacgttgtaaaatagtggctacttcggtagaaccggtaaacatcactgcacgcacacgggcatcattaaccagtagcgcgccaacactgtcaccgcggccaggtagcaattgcagaacaccctgtgggatgcctgcgtccagcagaatacgcacggcctgtgcggcaatgagtggtgtttgttccgctggttttgccaaaacactgttgcctgctgctaacgcggcggcaacctgaccggtaaagatagccagtgggaagttccacggactgatacaaacaaccgggccgagcgggcgatggctatcattggcgaagttatccctgactataccggcgtaataatgcaagaagtccacggcttcacggacttcggcgatggcattactgaaggttttacccgcctcacgcaccagtattcccatcagcgtttgcatctgattttccatcaactcagcggcgcggattaagatagcagcccgttcagccgggggggtggcaaaccagatagcgccagcacgggcggcagcatccaatgcacggctaacttcaccttcggttgcctcgcggacatagccaaccacatcggcaggttctgccgggttgataaccggtagcgcgtcaccgttgtcctgctctgcatcaatgacgggctccgcacgccatacctggctggcactggccagcaacgcgctggagagcgacgcaaggcggtgttcgttggcaagatccaccccgctggagttggcgcgatctttaccaaacagctcacgtggtaaggggatacgcggatgaggtaaaccaagttgaccttcagccgccgccatggcttctaccgcactgaccgggtccgcaaccagttcatcaaggggtaatgtggcatcagcgatacgattgacaaacgaggtgttagcaccgttttccaacagacggcgcacaaggtaagccagcaatgtttcatgggtaccgaccggagcataaatacggcatgggcggttgagcttaccctcggcaactttcccgaccacttgctcatacagtggctcccccatgccgtgtaggcattggaactcatactggccggggtagtaattttgcccggcaaggtggtaaatcgctgacagagtatgcgcattatgcgtcgcaaattgcggatagatcaggtttggaacagccaataatttgcgggcgcaggccagataggacacatcggtataaaccttacgagtataaaccgggtatccttccaacccgtcaatttgagcacgtttaatttcgctgtcccaatacgcccctttgacgaggcgaatcatcagacggcggcggctacgttgtgccatatcaatcacggcatcaatagtggacggacaacgcttttggtatgcctgaataacaaaaccaatgccattccaacctgccaattggggttcgaagcacagcctctccaacaggtcgagagagatttccagacgatcagcttcctcggcatcaatattgataccgatatcatactgacgggcctgtaatgttagcgataacagacgcgggtataactcgtccatcactcgctcatattgcgcacggctataacgggggtgtagggcggaaagtttgattgaaatccccgggccttcgtaaataccacggccatttgaggctttaccaatggcatgaattgcctgttggtaagagagtaggtaagcctgtgcatctgcttcagttaatgccgcttcgcccagcatatcgtaagagtagcggaaccctttatcttctaatttacgggcatttgccaatgcttccgaaatggtttcaccggtgacgaattgctcgcccatcaagcgcatcgccatatcgacgcctttacgaatcaacggctcaccccctttaccgataattcggttcagtgagccggagagtttggcttcgttatgggtagagactaggcggccagtaaatagcaggccccaagtggctgcattgacaaacattgacgggctacgtcccagatgcgaatgccagttgccgttgctaattttatcgcggatcagtgcatcgcgggttggcttgtcaggaatacgtagtagggcttcagccagacacatcaatgccacgccttcctgtgaagagagtgagaactcttgcagcaatccctgtaccatgcccgcgcggccatgggcacttttttgattacgcagtttttcagcaatggaataggccagtttatgtgttgcttgcgctaaatctgcgggtaggcgtgcttgttccaataacatggggatcgcttcggtttctgggcgacgataagccgcagtaatggcggcacgggtaaccgactgcgggagcacgtgttccgcaaaatccaagaatggctgatgagtgttttcagtgagttgcggtatagcatcttctgtgtcttgcagagagagtgaacttgttgttgccagttctggcaattcactgttactttctagtttttctaagtagttgaaaatagcctgtttaatgagccagtgtggtgtgcggtcaatacgttgtgctgcactcttgatgcggtctcgtgttgcttcatcaagctttacgcccattgtggtactcgccatgtcgctcgtctcctttgataaggggaattatgattttatttctgacaatatcaggcatgttgcaactttgtgcaaccacgttaaatctggcggtgattgaagtgtgaattcagtctgattttttaacaattttggtaaggcgaattcagggttaataatgatgtgtaatagcttcagaccctaacaaatatagggtttataacgaatttaccttaggtacaactcattttacattggtaggtgtaactgcatctcagcatttaatgtgatgtggcgtgagttttttgtaaattttttgttgaaattgttgtgactaaagaaaagactcctctaggatagcaaccatgaggcagccgtcgattagtcaatgggtggtactggtggttcatccgttactggcgggtatttcatcttttactaatggttatctttggtgcaacccaatgtcttgttctgataatgggcagagaaaaagcgtagagaagcaagcgctgaatgtcttaaagatgacgaaatgtattaaagatggcgaaatatattaaaacgataatatgcacaatggagacgtagcatgaccatgaatacgccgatgctggtgacatttttagtttacattttggggatgatattaatcgggttgatcgcctatcgggcgaccaataacttcgatgactacatcttgggtggccggcgtttaggcagtgtcgtcaccgcgttatccgcgggtgcttccgatatgagtggctggttattaatggggctaccgggtgcggtttttttgtccggtatttccgaaagttggatagccatcggcttgacaatcggtgcttatcttaattggaaatgggtggcaggccgtttacgggttcataccgaagccaataataatgccctgacattacccgattatttcaccagtcgctttgaagacaagagtaaattactgcgggtcatatccgctgtggttatcttagtcttctttactatttactgtgcttcagggattgtggccggtgcgcgtttgttcgaaagcactttcggtatggactacggaaccgcattatgggcaggggccgccgcgaccatcatctatacctttattggggggttcctggccgtaagctggacagatactgtacaggcgacgttaatgattttcgccctgatcctgacgccaattatcgtgattcttgctgttggggggatagatacctcaatgatggtgatcgcggcgaaaaaccccgcaaatattgatatgttcaaagggttgaatctggtggcgatcctctcgctgttgggatgggggttgggctactttggtcagccacatattttggctcgcttcatggcggcagactctcatcgtactatccgtagtgcccgccgtattagtatgacctggatgatcctttgtctggcggggactatcgcagtaggcttctttggcattgcttactttgaaaataaccctgagcaagcagggaatgtgagccaaaatggtgagcgggtatttatcgaattagctaagctgctgttcaacccgtggattgccggtattctgttgtcagccattctggctgcggttatgagtaccttgagttgtcaattattggtgtgctctagcgcactgaccgaagatttatataaagcattcttgcgtaaaaaagccagccaaaaagaactcgtctgggtgggccgtgccatggtgttattagttgcattgatagctattgcactggcggcagatcctgataatcgggtcctcggattagtcagctatgcatgggcaggcttcggtgcagcttttgggccagtggtccttatctcggtgctgtggccacgaatgacacgtaatggtgcgttggtgggaatgctggtcggtgccatcacggtgcttgtctggaaacagtatggctggttagatctgtatgaaattattccaggcttcttgtttgccagtttggctatttttgtcgtcagcctgatgggccgcgagccaagtaatgccatcaccgaacgtttccataaagccgaggcggagtttaaaacagtttaatcgtctggcgttctaaacctatcaatacgtttaactacacatagcctcctgccataacagggggctatcttgtatgtaaaatcatctttgtatgtaaaaacgtcgatactcacttgtatgatatggcggcatgaaaacttactatcctaatgaattcacttgctatttaactcgctagaaacaacttgccacagtttggttaacaataatcttgttatgcctcttgaatttctttttatcagaatgataatcacaatcgttttacttttctttacgtaaactgacatggcccgtatttataaatttaattacccacatcaggggtgtttagcacgttcgtcccatttcttattatgtttcgtgaagggctggaggcggcactgattgtcagtctgattgccagttacctcaagcgtactcaacgcggtcagtggatgggcgcagtctgggttggtgtggtggtggcagcggtgctttgtctcgctatcggtatctttatcaatgaaaccaccggtgagtttccacagaaacagcaagagctgttcgaagggattatcgctgtagtcgcggtttgcatattaacttatatggttttctggatgcgcaaagtctccaagtccgtcaaagttcacttggaaggggcaattgataatgcgcttaactctgggcgcggccaaggttgggcattagtggctatggtcttctttgctgtggcccgagagggtcttgaatctgttttcttcttgttagctgccttccaacaggatgtcggtatcggggcacctattggcgcgatactcgggttggtctgcgctattttggtcggaatggccatctattggggcggcgttaaattacatttagccaaatttttcaaatggaccagcctgtttattctgttcgttgccgcagggcttgccgccggtgctatcagagcctttcacgaagctggcttatggaaccatttccaagatattgcttttgatctgaccgatgtgctctctactcactcattattggggacgttccttgaagggatgtttggctatcaggaagcaccaacggtgagcgaagtgtctgtctactttatctatcttattccggcgttgattctgtttttccttccaccacgttccactgcgggttcggctatcgctgcggcgcggaaaattaatccataactaaaatgatcagttcagggagttattacatgtctatttggttcttccgtcgcacagcgttacacgccgcgttgttgtctctgcctgctttcgctatcagcgcacaggctgctgatattccacaggttaaaatcactgtcaatgataaacaatgtgagccaatggcactgacggttcctgccggcaaaacacagtttattgtgcacaatgttagccagaaaggactggagtgggagattttaaaaggggtgatggtggtggaggaacgtgagaatatcgcgccaggttttacccaaaaaatgacggcgaatctggaacctggtgaatatgatatgacctgcggcttgttaagtaatccgaaaggtaaattaactgtggcagcaggtgaacaagccccggtgaaacccgatgcgatggcattagtcggcccgattgctgaatataaggtttatgtcacacaagaagtggctcagttagtcagccaaaccaaagcgttcaccgatgcagtgaaggctggggatctggcactggcacgtaaattgtatgcgccgactcgccagcattatgagcgtatcgaaccgattgccgaactgttctctgatttggacggcagtattgatgcccgtgaagatgattttgaacagaaatcggcagaccctaaatttaccggtttccaccgtttagaaaaaatcctgtttggagataacacaaccaaaggtgcagataagtttgcagacctgttgtatcaggacacattggaactgcaaaaacgcattgctggtctgacatttgcgcctaataaagtggtgggcggggcggcagggttaattgaggaagtcgcagccagtaaaattagcggggaagaagaccgctatagccgtaccgatttgtgggattttcaagccaacgtcgatggcgcacagaaaattgtcaatctcctgaggccattactggaaaaagcagataaaccattactgcaaaaaattgatgcgaattttaacacggttgatagcgtgctggcgaaatatcgtaccaaagagggttatgaatcctacgagaagctaaccgatgcggatcgtaatgcgatgaaaggaccaatcactgctctggcggaagaccttgctcaactgcgtggtgtattaggtctggattgaggttgttaacatgagagacaaaaccggcccgaaattcgggccgtatcaaccggatgatgaggcggtgtcgccgtcacgtcggcgtttaattttagggatgggcatggtgagtggtgctctggtattgggcggggcgaaaactgcccaagccgcagattgtcgatcacctgatgtcgctggaacccaagatgagcgttggcaaaaacagccgttttatggtcaacatcaagcgggggtgttaacgcctcaacaagcggcaatgatgttggtggcttttgatgtactggctaccgataaaacgtcattaattcggttattcaaattactgaccgaacggctggcctttctaacaactggcgggcgggcaccatcagtgaatgccaaactgccgccactagattcggggatcatgggacctgaaatttatcctgataatctgaccgttactgtttctgtcggtaatgcattatttgatgagcgttttggtttacaggggcagaaaccgctgcgactacagcgaatgacccgctttcctaatgactctttggatgcggggctatgtcatggtgatgtgatgttgcaaatttgtgctaataccaatgaaacggtgatccatgcgctgcgcgatattattaagcacacacccgatctactcagtgtccgctggaagcgtgaggggtttatttctgcccatgctgctcgcagtaaaggtcaggagacgcccattaatttattgggttttaaagacgggacagcgaatccaaaaatcagtaataaaccgctgatcaataatgtggtctgggtatcaaataatgcaggcgagcctgcatgggcggtagggggaagctatcaggtggtgcggataatccgtttcaaagtggagttctgggatcgcacaccgttgcaagaacagcaaaccatttttggccgtgataagaacagtggcgcacctttgggaatgcaacatgagcatgatgaacccaattacgccaaagatcctgaagggaaggtcatcccgatggatgcccatattcggttagccaatccacggacaattgaaacgcagcgtaacctaatgttgcgccgtggctacagctactcattgggggtctcaaactccgggcaactggatatggggttactgtttgtttgctatcagtcggatttggcgcaagcgttcttaacggtacaagaacgcctaaatggtgaagcgttggaagagtatgtcaaaccaattggtggggggtatttctttaccttacccggtgttgcagatgctaatcactatttggcacaaagcctgctcgaagcttaaaatacagcaccgccatcatcgcgcggtgctttttatgacgtctacattcttttatggcgtcatgttcattgtcatttctttatgatcaacccttcagcttggccgtaattttcgctacatgttcaccttggaaacgggctatcgccaattcttcagcgcttggctgacgggaaccgtcgcctccggcaattgtcgttgcgccataaggtgtaccaccacgagtctgcgagacatcaaataactctttggcaccataaccgattggaacaatgataaaaccgtgatgggccagagtggtccaggttgaagtgatggtgtgttcttgtcctccgcctgtcccggtggaggcgaatacgctggccactttgccatacagtgcacccgatgcccataacccaccagtctggtcgaggaaggtccgcatctgcccggacatgttgccaaagcgagtcggtgtaccgaaaataatgccatcataatcggccagttcgtgtggtgtagcgactggcgcttgttggtttgtttttccacctgctttagcgaaagcttcggctggcatggtttcaggtactcgttttatggtgacatcaacgccactgacttttctggcaccttcggcaatcgcgccagcaagtgtttcgatatgcccatacatggaataatagagtactaaaattttcgccatctcgcggtgctccaatcaaatttattgaataaggctgatgatgtcattagtcgtcgcggctaatgacacctattaaccataagctaatcagcacaggctgcaacttttaatccacgaaaggtaaaataaggcgggcagcccaaaggcttctcttgattgataggcttctgggctattgataaaaatctgatgatttcagccctaaatataaatcatgcttcagggggttatcacagttgtttatcaatccatattgacagcatgtgacgcagttaatatcttcaatgacaccttgactccataattaaattgttaatggagttttgctctccttgggagccatactgctaacattatggttccaccacgatgaattaatgaggaacactgctgatgacccagttatacccacaatataagaaacaattgacgacaaaaatagtgctgtttagtgcgttatctctattgatgatggcatcgctacctaatacctatgcggaacaatatcctgacgttccggtaccatttaaaaacggtacgggtggcaaagtggagaacagcttatatgtggggctggggagcgccggtgtatcgtggttccgtctggatacagataaaaccggtgctgggtggcagaaagtggctaatttcccaggccagcctcgtgaacaggctgtgacggtggtattggcagggaaactgtacgtgttcggtggggtggggaaaacgaacgccaacgatacccaagtacgggcactggatgatgcgtatcgttttgatccacaaactaatcaatggcagcaactggctacccgcgctccccgaggtctggtggggaccgtggccacgacactggacggctcccaggcggtgctgttaggcggtgtaaataaagcgatttttgacggttattttactgatcttgcgtcagccggaagtgatgaagtacgcaagagtgcggtaataaacgcctattttaatcaggctccggctgattatttctacaaccgcgatgtccttatctatgatccgcaaaaaaatcagtggaaaagcggcggtttgctgccatttttagggacagccgggtcagccatcagccgcatggataatcgcttgatattaatcaatggcgaaattaaacctggtttacgcacagcggctgtatggcaggggctaatgcaagggaatgtactggagtggcagccacaaccggacttaatcggagctgaaacgggatccgcacaggaaggattggctggcgcattttccggtatcagtcataaaacagtcttagtcgccggaggcgctaatttccctggtgcctggaagcaatttaatcgcggtcacctatatgctcaccaagggctggaaaaacagtggcaccagcaggtgtatgcgttggtcgataatcagtggagaatcgccgggaagttgcctcaaccgctgggttatggcgtctctattcaggggccagataaggtcattttgattggcggcgaaaccaccggaggtacggccacttcagcggtcacacagctatcttggcagggaggaaaactgcatattgagtaaattgaggttgaaatgaatgaaagaaccttattcagtagcgggttgtcggcgttatggaataagtgattagaggggaaaataaaacggtaccagaacacctctggcaccgttttatcacactgtggttatttactgttatataaacgggctctgcgttttttcaggaagatatagctggcagtcaaaatgacaaaccatagcggtgtaacaattaacgcctgacgggtatcactttccaatgtcagcagtaccaaaacaaaggcgaaaaacgccatacaaacccatgacataaaaataccggctggcattttgtagatggattttttatgcagtgctgggcgtcttttgcgatacaccaaataagagcaaaggatgatggtccagacgaacataaacagaatggccgaaacagtggtaaccaaggtaaagaccgtcatcacgttcgggataagataaatcagcaccaccccgcctaacagacagatacaagagaatgtcaggccagtggcaggaaccgaacggcgtgatagcttgccaaattgcttaggtgcatcgccttctttcgccagcccgaacaacatcctgctggtggagaacacgccactgttggccgaggaggccgcagaggttaataccacaaagttaatgacactggccgctgcgggcagcccgaccaagacgaataactcaacaaacgggcttttatccgcgacgactgaactccacggcgttaccgacataatcataattaatgagaaaacataaaacatgattatgcgaatcggaatggagttaatggctcgtggtaaaaccacctctgggtctttggtttctgccgctgtggtcccaaccagttcaatacctacaaaggcaaaaacggcaatttggaagccagcaaagaatccactgatccctttcgggaacatacctccgtcactccataaatgcgtaaatgaagcggtggtaccagatggtgactgatagctgactaagaccatggttaggccagcaaaaattagcgccacgatagccacgattttaatcatggcaaaccagaactccatctcaccaaacatttttactgtggccaagttcagtgacaacaacagtaaaacgactaatagcgaggcaacccattgagagaaatcagggaaccagaactgtgcataagcggtgatggccactacatcagcaataccggtgatgacccaacaaaaccagtaagtccaaccggtgaaaaaaccagcccaagggccaagtaagtcagcggagaaatcactgaatgatttatagttcaaattcgatagcaacagttcacccattgcccgcatcacgaaaaacaacataaaaccaatgatcatatagacgaaaatgatcgacggcccggcaaggctgatggttttgcccgatcccataaacaacccggtacctatggcaccgccaatggcgatgagttggatatgccgattggagaggcttcgttggaggtgttcttcaggttcttgtaacggctctgccactattttggattggtctaccatctttcccattccctcttcctgtatttgtgaagttattgagctctagattggctctttggttttatctgtttgacctgtctgtctgttttttatgcattaaagataatttgcgaataatttaatattattgcaacaataattacacatcactcttcattttccactgtttatatttcacactcttatttttgttaagtacatcacagtgtttggaattacaacatgaagtcgcataactaacaataatcgtaagtgctggatgaataattaatcttctctcgtgggtatagagtggtataaagacaaaaactcaatgaaatgtttgacaggcaggtttaacaggagaataattattcgcgttgggtcgttagctcagttggtagagcagttgactcttaatcaattggtcgcaggttcgaaccctgcacgacccaccaactaaatcaataagttatattatccccctcattttttatcattccttttgtcatattcgtgccgtctctattcagtatagggtttatttatcttgtatgttaaattaaattaattgatatggagtgtgcctattgtgccatagcataagctggtttcaatctgttcatcttttataaggtggtaatagatatttctgatggaattcttatcctcagacatagttactttcatttttaatttcttatattaattattgtccgttgtcatatcatgcataaaatgataggggatctgcttggtgatctagtgatccaggttattgaacgtagccaacgcacatgcagcttgaaatatggcaggtagatacacatccaagagaccagagagaatagctgtgactaattaactttttattcttaggttctcgatctaatatacatctattttatttttttaataaccaagcctaatttatactaatgcttgttgttatttttcgaaattaaacctttccttttgtttttattctgcttaatttgaacctattccattatcagtatattatttttttgagtatttgctatgaaaaatggaattttgtgtttgtgatggactactggctgaatattagtgaccaatgcgacgataccgtaatctaagataataatttaaggataaaagtttaatgaaaaataaaaccacattggctgcatttataacagcgatcttattaagcagttcagcggcctatgcggcaggggatcgtaccatctcattggggtatgctcagggagatgtaagactcggtgatggaaatcgaaaagacattagattggacgatgatcttaaagggattaatgttaaatatctccataagttgagtgaaatgttcggtgcaataggctcttttacttacacggatttaaattatgattatctaaataataatgtcaaaattggggatgcatcctttgattattattcgctgatggttgggcccagcgtacattttaatgagtttttcagcatgtatgcattattgggaattgggcatgggaaagcgaaagcatctgtattaggttacggtaaaaaagaggagcaagactctttggcatatggtgttgggatgcaatttaatccacttaacaatattgctattgatgcttcatacgagtatgcaaaacttaaaaatgctaatattggcacatgggttttaggcattggctatcgtttttaataaaatactttctatataataataacagccgtattagttcactgtgcggctgttttttcatcagttgcaaagagattcataacgataaaaaattgagtccctgacgcggttaatgaactatgtgttctagccttacacgccatcggataagtcatgctgtattttaatgtaacaatctgacccgcaccaagtgtagtatgggggccattcttagcgggcaataaagtctgttttttaggaatgccagtggttggtcatttcaccaatattttttgatgtcacttaatcgtttttaaggtttgtgttaagctacaatgattaaaatttaggtgatcaatcatggtattcgtcgttctttggttcgctattgcaggattaagtgagtatctcgtgtggggctatccattgttagccgttgctttggctctgttttttgtcattcttggtggttattgggtgtataaaatcaggaaaattcaggtgactgaggcgatatctgctgaaaaaaaatcaagatctataaataatcttaatttaaccttcgctgtcgcgatgttggctgttcatgcgctgatattgttactattacgttgacttgatatgtacctttggtgcaactcttcattggctatgccactggctccagattgatatcaatatccaggcggcaataacccaacataaaacggcagaaatcaaggctagcgataaacgcatgtgttcaataaaaaagtaaagcgatatcagatagataaaataagggatgatggcccacaagccgaatttaattgttatacgcaaagcatcaatactacgttcagtaccaacaatatagtgagtgataagggcaaaagtagggaaaagtggtattaagccagcaatataatagtgacgagttttcgacagtagtgcgatcatcagcaccattccagtaccaatcaatactttaagtaacaatcccatcatgttctctagttataaggtgataaactgcccgtacataatatttcaatggcaaacagtgaaactctgctattacgtcaattggtagctcaaagaagtgaaggggccactatgctggccctaggcgttattggcggtagccgttcttaatttgagcaagtgtatttgtgaagacttcagcttgagcagcgtcttctataccggcgatagaacgctcaatatttaagattactttcccagcatcggcttggccgatcgctttcagtaacagagtcagggttgctttcaagcatgcgacttcattggctaaaatttgtggatcagcagaagtcgtaaagtctggattactcattttgtctccggaggctagcagtgaacatttgtggcattattaaacagttacaagattatatcatagaatgatcggacacgttgtttgtatgtgtatcatttttctttgctgtatcaatgcttgcttttttgggcacgttgtagaaaaagagagggggaaggaaatcgtgacattcatcatctaggtattttcctaattaagcgaatgttcacataaagcagatgttttttttaggaattaaataatttgtatcaaaattagcgtaacttcgagcgaataaaatacaaacagccatgagacaaatatgggaataattcctatacttttggattgcatgggtttttaatctctatttatatcaatgaattgtgtttttcctcataggaattaacttatctaaagctaataattagttttttgaatgtatgaagatgcaaaccaagaagtatcttaaaaatacgtttcttttttatcgtgttgtaaactcaatatgtttgagattttatgtacataactaaaacaatgataaaaataatatctgtcaaacaatatagatatgattttgcaattattctgtattcattctttggacgaaaacaagtaatatcattacggtaaacaaagcatggttagtctactcccttatttctggagaaatttctttgatcagcgttcttcttgttgatgaccacgaattggtgcgcgcagggatacgacgcattcttgacgacatcaaaggtatcaaagtcgcgggtgagatgcagtgtggtgaagatgcggtcaaatggtgccgtagccatgttgtagatatcgtcctgatggatatgaatatgcccggtattggcgggttggaagcaacacgtaaaattttacgtttttcgccggatactaaagttataatgctaaccattcatacggagaatccattaccggcaaaggtcatgcaagcgggggcgggggggtatctcagtaaaggagctgctccgcaggatgttataaccgccatccgtatggtacatgctgggcaacgttacatagcttctgatattgcacaacaaatggcactgagccagcttgagcctccagcagaaacaccttttagctgtttgtcggagcgtgagttgcaaataatgataatgataacgaaaggccaaaaggtgaatgagatctcagaacagcttcatctgagtccgaaaacggttaatagttatcgctaccgtatgttcagtaaactcaatattagtggtgacgttgaattaacccatttggctattcgccacggtttatttaatgcggagacgttatcaaatagtgactgatctttttgattataaagaatttttgaaaactgttaccagtcagcctggtgtttatcggatgtacgatactgcaggaacagttatttatgtcggtaaagcaaaagatctcaaaaagcgtctgacgagctattttcgtgctcaggtcgccaaccgaaaaactgaaacgttagttaaaaatattgctcaaattgatgtcaccgttacgcatactgaaacggaagcattgttgcttgagcacaattacatcaagctttatcagccacgttacaatgtgttgctacgtgatgataagtcatatccgcttattttcttgagtgcggatgagcacccgcgccttgctgtacaccgtggcgcaaaacatgagaaaggggagtattttgggccgtttccaaactcctatgcagtgcgtgaaacgttggcattattacagaagctttttccagtaaggcaatgtgagaatagtgtttaccgcaatcgctcacggccttgcctacaatatcagattgggcgttgttccgggccttgtgtggaggggttggtaagtgaagaggagtatcagcgccaagttgattacgttcgcttgttcctctcaggtaaagatcagcaagtcttgacgcagctaatcacccgtatggaggaggctagccagcaactgcattttgaagatgcagcacggattcgcgatcaaatccaagctgtgcgtcgagtaacggaacaacagtttgtttctggcgacagtgaagatcttgatgttatcggtgtggcatttgatgcggggctcgcttgtgtccatgtactgtttatcagattagggaaagtattaggtagccggagttatttccctaaagttcccgcgggtactgagttgagcgaagtcgttcagacttttgttgggcagttttatttgcaaggaagccaagggcgtacattgcctggtgaaattttactggattttaccctcacagaaaaagacctgttggcatcttctctttctgaactggctgggcgaaaaattcagatacaaagccgcccccgaggagatcgtgcgcgttatctcaagttagcacgtaccaatgcttcaaccgcattgataacccgcttatctcagcaatcgactattcatcaacgcatgaaggaattagccaaggtccttaagcttgatgaaattaatcgtatggaatgttttgatatcagccatacgatgggggaacagaccgtagcctcttgtgtcgtatttgatgcgaatggtcctgtacgatctgaatatcggcgctacaatattagtggtatcacgccgggtgatgattatgcagcgatggctcaagtactaaaacgtcgatatgggaaagcattagacgatcaaaaaattcctgatgtcatatttattgacggtgggaaggggcagttgtcacaggcctttgatgtttttgcctcgttgaatgttccgtgggataagcaaaagccattgctagtcggtgtagcgaaaggtagtgatcgcaaagcgggtttagaaacattattcttggcatcagaaggtgagggcttttctttacccccagattcaccagcattacatctgatccagcatattcgtgatgattctcataatcatgcgataaccgggcaccggcagcggcgatctaaagtaaaaaataccagtgcgttagaaatgatagaaggtgttggccccaaacgacggcaagctttgttgaaatatatgggtggactacaacctttgtttaacgcaagcgtcgaggaaattgcaaaagtgccgggtatttcacaagcattggcagaaaaaatccacaatgcattgaaacactgaagctaatgttgcaccatactcatagtgtccacaccagccagatagttatcgtagcattatgcaattgaatataccgacttggcttaccttgttccgtgttgtgctcatcccattcttcgttctggcgttttatttgccgttcgtctgggctccgatggtttgcgccatcatatttgtgtttgccgcggcaaccgattggtttgatggctttttagctcgacgttggaaacagacaacccgttttggtgctttccttgatcctgtagcggataaagttatggtagccgttgcattagtattggttgctgaacattaccactcttggtggattacattaccggctgcaacgatgatcgcccgggaaattatcatttcgtctcttagagaatggatggcagaaattggcaaacgcagcagcgttgcggtgtcatgggtaggtaaggtaaagacgatggcacaaatggggtcacttgttgggttgctttggcgccctgaccacaatgttgaacttgccagtttcgttttactttatattgctgctgtactgacattctggtcaatgttccaatatttgaacgctgcctggagtgatttgctcgaaccttgatcgaagcgccgtaaaaagcagcaaacgaacgaataattcagataattttattgactcattgcgtcaggtaagtagaatgcatcgcatcagacggcagcaacgaaatgtcgaaagatagcaaaagaatcagtaggttctgatgttgcgggaatagctcagttggtagagcacgaccttgccaaggtcggggtcgcgagttcgagtctcgtttcccgctccaaattaataggttggcattagcgaaccttagctgtaaaggcaaagaagaataaggcgcgttggcagagtggccatgctacggattgcaaatccgtctacctcggttcgactccgggacgcgcctccagttttccagagcccgggtggtgaaatcggtagacacaagggatttaaaatccctcggcttatggctgtgcgggttcaagtcccgccccgggcaccatggaaaatattctaagtaaaacaaagtagtacgagtatgtcgttaaccgccgagaggcggtttttttgtttctgagatttgaaaatggcagcagagtgactacaaaatgactacattgtgtctacggcacttttcacatcctcaaggctgcatccagtagcaagtacgataaacagttagttatcccccaacaaaatattaattacacagaattttgatataaaaaaacctgcaatttgcaggcttcttcaattacatccacaacacgccttgattccctttagggtggggcgggacagcattaattattcccggttccattatcgtatcaacgatagtttcatgggtcttaaaggttttgccacaattaatatttgtgcactggtgatagcgttctttcgtttcgtcactaaggtaacggctggatctcgcgtgtgctgcaaatttacagcgtgggcaatgcatcatgtttacctccgaaactgcatattcagtaattatgctgatcttatcaccagtattcggatttgtgaactaaatatcaattagttgaatatagctactctgtggcctcataagtcacatcagacagcaacacttcgagagataattgagtggtgtagccgctgttgctcaggctgtgcgctaccttgctgattacccagctctgttggtctatcactgatttgaagccattgaccgcaacaggggtttcaggaaataaatcagcacgccccatggctaatgtgatagagaactctgccacaccgcgctgtaacttctcccacttggactgggcggcgcgcatcgcggctttttgcgtggcgtaaatggtggtaatggcaaacacgttatcctccgcccccacaagataatccccttgcttctcctccaccggcttgacttctttaaccgccttggcacgggtcggcgcggccttggggtgctccagtgcgcggagttgcttaaatttcggcttgcgctgcaacttaacctttttcggctttaccggtttggggtctttggtgtgcaaccaactggcactcacgccggtatacgcgccccggtcagcaatactaaagctgtgctggtcaccatcgtgccgggtgatcgtcatttgtggaatgggtttaccgctggccgtgacagcgctccccggcttgataaacaacaatcgcccggctttgacggcggctaccgtgccattaagcgaggctaaccgggtgataaacttggcgtcagtttcttgcgtctggtcgatatgagagatagcgatatccgccagaccatcagccagcatagctttcaggttgttacgctccgccacttgcgccaccactttacccagtgttgtctcatgataagagacttcacgccgcgcattaagcgaaccccgaaagtccgcactgcgggcgcgaatggtcagcgtatctggcgcgccgtgatgctcgacctcatccacgataaaatcacccttacctatcagcgccgaacctttccagcccaagaatactgacagcactgcgccccgttccggcatggcaagctggctgtcagcgtcgtccagttcaatatcaagctggtcagcttcaaagccccggttatcggtcaggctcagggacaacagccgatcacgaatattctgggtgatatctttcgcgttaatattcaacataaagtccggggccatatccgccccagccgggagtgaaatgccggtcatcatgagaataaccctccgattgccgcctgtgctttgcccgtcattgccgtcgctttacccagtaattcgtctgcctgttgttgtagatcgccaaacatggccgttaacgactcatcaacccgcagcagattgagggtgaactcaatgcgccgggcgctgccatcagcaaaaaacagactgcgagtctggcttaaactctcaaccacaaacataccgtaaatcatgccgctgccctcaatcaacgaccatgccttgccctggtcagccatcatttccagcgccagcaatgaaagacatccgccggtgagttccggtaacagcaccccggataacgtgattttttccccctcaacccccaaaaattgcgcggacgggcgcaggcccacccggctgttggtcggccagcggtaatcaatattgcggctcatgctttggtaaggcgtggtttgcagcataaacacaaataaacccagtgatagcatcattaatcattctccatctggccgcgttggcgggcgcgtttgtcgcgttcatttttggcaagggcatccgtcatcattttttcagcatcctgtcggctcatgcccggtggaatgttgatgttgatgtcattggtggtcacactgctatcgacaatggtggtacccgtattggcggtgacgggttggtagccgccagaccaaccactcgtcccatagccgtaaccgtagcgcggctcatctgggattttgtcggccagatcgttcgacttagtatcgataatgccaagtttttccagcacccagtcaatgccagcgcgcaaggtatttagcgcattcatcggcagacagagcgccgccgccagcccctcaccaaagactttacctgcgttggtcgcccggtctaatgtttcctgtgtggcttttactggccggatcaggtcagcgaaccagttcgccagttgcttcaccttgtcactaaaccacgcgaataccggtttaagcggttcaaaagcagcactgaccggccccattgcggccataaacccctcagccacaccagcaataaaggcgctgataggctcccagtatttacggataagcagcgcgccagcaacaatggccgcgaccaccgccactatcggccatgttagcgccgtgagcgcggcggcaatagttccggccatcagagaaaagccggtactcaacaacccggccccggccagcagcaggttaaacccggtcatgaccggccatgcaatcagccccaacgcacccagcccgccgatcaatgccagcgccgcaccggtcactttggtgagagtcgcgaccagctccgggtttttctttgcccagtcagcggccttaatcagccagccggttgcggtgacggtcagtttacgcagagcggaatcttgcgtttcaaagacttcaatacgcaagtcttcccatgccgacgtcaggtttttcaagtcaccatcaaggttatccattttgacagcagcaattgcttcggctgtcccctcggcctgtaccagcttgcctttcttctcggccagcttgccattaccggcagcagccaccagtttcactgcgcctttcatcgcctcctcaccaaaaataactttcaggtattcggcttgctgcgcagtgcctaacttgttctttttaaatgactgactgatatctttgagtattttctctaccggcaacatgttgcctttgctgtcgcgagtggtgatacccaattcacgcagtgccaccggtgccacgccgcgcggggcctgtaatcggctaaataccgcactggtactggtcccggccatactgcctttaatgccattatcggccagcaccccaagcagcgcggtagtatcttcaatactggccccggccgcctcggcaattggtgccacatatttcatggcctcacccagttctgacaggttggtgttcgaactggtaaagcctttcgccatcacgtcagacacgcgctgtatctggtcgaggggcaggttaaaggccgattgcatattagtcacaatgtcggccgcttcggcaatatcaagaccggaggccagcgacagattcactgttggcgcagtggcggccagaatggcgtcagcgtcataaccggaacgggccagcgtgtcttgggttcgtgccacgtcagttggggaaaacgcggttgacccgccgatatctcgcgcttgctggcgaatggccgccagttttgcgtcttttttatccagacctaaaatagcctgagtaccagacatctggctgtcgaactcaacgccgggcgcgatcagtctagcggctccgtacaacccggcagtggcaacccccacactgaccgcgctggcattgcgtaccgccccggcagcagcccggccgcgctggtaacgcgcgctgatacggttaagccgttcctgtcgctggctcagacgttgcagctcctgccgctgacggctcagggcggcggtggcttcggctgcactactgcgtaaccggcgctgttcactgctcaggtttcgggttgaaataccgctggcattgagggtgtcacgctggcgttgcaccgactgacgcaagccgttgtatttggtttgcaggtcagaggccgcgcgcttggccccctccattaaccgtgtttgctgggcggtagggtttgcggtgtttctcaactggatcgccagcgccgccgcattttctttggcttttttcagcgcctgcccggtcacggccagttgagcactggccttacgaaagccatcaattttagcggattgagcttccagcgctttaatgctgccttgagtggtacgaatatccccggacagcgctttgctggccgcctgtaccgctttaaacggacgggtggcctgatcaaccgccctgagcaatacctgtaactgtaagctcctactcattgtttacggctccactgcgtaacagggctttatgacgccagcgcaccagctcggtgaggtacatcccccaacactccgagggcggccagtgaaagatggcagcaatatccgccatcaggtcgtcaacttccagttccggatcgaaggttactccgcctgtttcggcgacaaaaaaccgatcaccctaccggccagcgccactaaatccggcagttctaaacggccacattctgccgtggtcagtgaggggtaagtgatgcgcggcaagacaaccatcagcgcatccacatcagagttggccacgtcagcaagacgcaccccgcgcagggtaccggcattggggcgaatgacttcgatttcagttatcagggtttcaccccgtttaatcggcgcttccagtaccacaatgttctcgttaatctcaatggtctgtgcgggtgtatccgtgatttttttcatgtttttttccagttcagtcagggaggaccagcggagtgctggccgtcgggttagcggccaatggccttgcgttgggcttcgagcaggtctacgccgttaacgatttcgatcaggttaaccacgtcaatctccatcacgactttgccatcaatggtcagcttgtaataagtgcattgtgtggacaccttggtttcagtgtcttccccttgcttggactcaccgccatcaatctctttatggcggccacggatctcgacctctaccgctgtgacttcgccagtatcatcacgctggtaagcgccagaaaaacgcaacggaaccgcgtcaactttgggtgcgccccattgctgcaacacgaactcgtcaagaccgcccattgcccactccatcgccagcgcgtcatcatccagccccaaatcaatcggcgctgcgccattcatcccgccgccccggtagttctccagtttgcgggttagtttgggcagggtgatggaggagacgatccccatgtaatcccggccatcgttaaacaggttcatcagtttcagcttacgtggcagtgccatagttcaggtttccttagctgttgacggcagcggcaaagttcaccagatatttatcggtgatacgctggcgaagagttaaatcttccagtggtggcactggggtgtagtcgtaatcaataaacagtttgcccgcttttagcgtgtctttatcgttggcgctgtcgtcataccagcaagtaccgtcaataatcagcccggcggatttcatttcgcggaacttggcgttgatgctgccaatcatgtctttaaccagtgtcgggtgcatcgggcggtcaatcgcccacaattgtgcctcggccatggtgtcagccagaatttgtgcggtgcgggtgtagttctcaaaagcgaacagtggatcatcggagcaggtacgcgaaccccaaaacttgaaaccgtctttgcgcacaagggtggttacacaggcttggttgagcaggtcggcgtcagtgccaacggtctgtaaatcccagtagacgctggcagagataccggtcacgccattcacgccgacgttagacagggttttatgccatcccgtctcttggtcaatcttggcgcgcaggccaagggcacgggcagtggcataagcaatgtcggtgctgttggccgtggtgttccagctcaggaagtccggccaaatcagcatcaactcgcgttgactgaaattgtcacggtacaacatcgcttctgaaatggttttgcaaccataggcgctgatataaccaaaggcccgtaattgctgacagatacccgccagtgcggttgagacctccagattatccagccccggtacgccgagaatgcgcgggcggacaccagtaacagactgcgcatctaacaacgctttcatgcctgtatagcggccgttctcgtcagcaccaccaataatattggtggtagtttcagcctcatctttacctgtagccacgcgaacgacaatggtgaccgggcgggcctgctccgcaatcgccagcaatgacgcggtcagggtaccttttttaccggctttaccggcggcggccagtacgttggtaatcagtaccggggtgttaaggggaaatgttgccgcgtcggcatcatcgctggtacagaccatgccgataatggcggtggaaacagtggaaataacgcgagtaccgtcgttgatttcgatgacgcgcgcgccgtgatgataatcactcatggattaactctctgttggttgagggtagagagtatggtgacgacttaccgtgcgaagggcatctgataggggatgtgtggtggttggtacaacgaaaaagccccgcaatcggggctaagttgaaatatcaggctgacagcggaggccagttgggaatgcaatacccctgatttactgcctcgatcaaaagccattgcggcagttccggcaattcaacctgtggccagttttcaaccgtgggccatgcgcgataggcggcgcgggtagcggttagctcggcacgttgagtatcagttagcgggctatcatcaattgaataatcaattacagtaattgaatccgtggttttgataaaagcatcgcgatgacggcgggcaagtgcggcgagggtatcgccgtgaggcgcaggtaacggcggaatatccagccagaccggacggcctttcataacccctaacattttccccgtggctggaacgtgtttccaatatttcgtttgttcttttttcgtgagcaatagtgcatcatcaggccagctacctgttgccagatattcttctttccattcctgcggataaaaaccgcccgttgtagcagaaaaatagatcatgttttttatccttaatagccaatggcgaaaataagtggatagcacaggttttgctgtgcagtgccaaaccattgcgggaacacctttaccgtgctgttattccaacgcgatgtttgaaacatcacatcggcttgtattgtgtcattcccctgagtggccgtgaatgccattagacacgcaacaggaaaggcggtggggaaagccagttcagggtaagcgatattttcgccggcagaaacagggccagtcatccattgcacaatcagcccgcccggcacgtctggaatacggatataatccgaaccagcaaagtgacgtttaccaaactgtgccagcacacccgcgattttattgttaataaatccccaaagatccccacccccttccccccacaccgccccggtgatatttccactgccatccataaacccaccgtcaagccctcccgcacgcactatcccattagaaataaaatgacctcgggtagtgaaatcaacacccccagtaacaaagttgtaatttgtcgcgaacacccactgctccccaccttcgggatgcgtattgacataatctgtagtgattgatgtgaccgagtcacgaatataacagcggaacccggcggaataggcatcagaacccggcgaacgacattcaattttattacgagaagtaataatcccggacgcgtcaatattagtttctgatttgatattacctgcgctcaatgtgtcacgaacgtgcaatgatttatcaaatgtgcctccccgtgtacgtgatacgacatcattggctgacgcggcacccacatcagagaatgccagttcgtccagttgtgcaagtttgcccaaccccatattttttcgaccttgagacttatcgttcacgcccgcaagattgtcggcggcacgtaaatattggtcgtgaggatctgtcgcagcgacgtgctcagacagtaacttatctgcatactgcctaacctcaattgctttgtcgtctgcatatttccgcgttgccaatactacggatgggtcgatttttagcgtgacagcggcggtgctgctgacaatcaaaatgacccgaatggtttgggtgcgcccgctgccctcttgcagttgcggtttataggtttccgcgcagttggcaatggcaatcaaatcaccgtctttatccagcaagccaatttcccggatccaccatccgccctcagtctcaggaataacctgttcagcaataatctgactggtattaaccgggtcaatggtcagcatattaagggcagcgcggcgctgttcattcaccagctgggtttgtgccgggttaggggttggcagagttccgccgccatccccaaccgccatttgggtgatctctaaacgggtgccgagcgcggtagcgttcgccagcttggccgcgccgatgttggtcagtaaagcaaagaatttcacggtcatgggttcactctcatgtcatcaataatatggactgcggcactggcgtaatcctcgccggtcacgattatggtttcaggcaaataggggtagatggtcagttcatcgccgctgtaactggcggcggccacatataacgggccgctactgtcgaggttgatagacagaccaactaagtgacggctgcatggcttggcgtcatctatcagccgttccagctcttgatacatttcttcggtaatgccggtttccaatacgccaacgtccaggcgaaaagtgccgggcgtttcgttagtcttccaccactcgatcaccttgatgagatagccgagcggctcaaccacccgacgaatagcaccaatggtgcctttgtgtttatggacatactgcgaggacttcaccaccgcacgcttggtggcttccggccacttctcatcccagcgatccactgaccacgcccacgccaaataaggcaataattccagcgggcaggtgtcggcgttccagagctggcgaatcggaaccggggtattttccagttcggcacaggcgcgggcggcggccacttccagtaccgaggaaccgactggcaataaacggtcagtcatctgtacccccaaccgtgatggcgctgccggtgcagaatgcggcttgggttttatccagcaccacatcagctatcggggcattaatcaccgcccgctggacaccctcgatatgcagcgcggcatacagtgccgacaggcgaatgtcgcggccaaggcggcgctgtgcggtaacaaaggcgttcagtttcttttcggctgccgcgcggattggctccgcctctggccccggatgcagatagagcaccgcgtcaatctcataatcttcaatacgggcggattgcactgtcacccggtcagccactggtcgtgtgttctcatcattgagcgcggcttccaccaccgccaacagttcgcttgatgctgcgccgttaccctcccgcgacaacaccgtgacggtgacacaggccggggtcggactgattgccgaggcatcggccacccggccgtcagcgcttttggcgtgatattcataagccccggttggcccggcgacgctcaagccctcaaaggcttgcgggatacgcacgcggaaatcactgtccgattccatcactgcctcaattggtggaatcgcggtggggtctgccggggtgatcaccaatcgctcaacattgttatttgcgccgagctggtctaagtcactgccgacggcataggccaccatcaccgcgcgggcggcatcattgacgcgttggcgcaagatcacttcacggtaggcgttttcctgcaacagcttgaccagtggctcagattccagcgacagggtacgggccacggcggcgcgctgttcctccgggtaaagagacatcagcgtcgctttgcgctcggccagcaaggtttcataatccagttcttccaccacaaacggcggcggtaacaggctcaggtcaatggttgccatagggtcagctcacaggaatagttaaagaaaaaggggccgcgctatcgctgcgggtgccagtgatatcaaccaccatttttccgtcaaaggtggtttcaaaagtgatgctggtcagcttaacccttggctcccagcgcagaatggcactgtaactggcggccataatttgcaagcgcagcgccggattttgcggctggtcaatcagctccgataacaacgaaccataagcgcggcgcatcacccgcgaacccaccggcgtaatcagaatgtcggcgattgactggctgatatgatcagcgtcggtaatggtctgtccggcgctccggctcatgccgagatatttggctgtggtcatcggatcccctccgtataactgccgccgcgctgaactccgccgtggtcatgtttatcgactaccacgccattggatgagaacgaaccgctggaatgttcaatgtttccgctcaacttgccgccttgggttacattcagcgtggcggtagtcaggttgttagtgcattccactactggcgtatccagcaagattttcaccgaggcagtacaggcgatattgggggcggtaacactcaccgattcactggcattgataaccgctgttttgacgccatcagcgcgcaactcgccgctgtcaggttcatagtgcaaagttgcaccgtcaggaaaggcgatatacaggccattcgccgaggccgacggcggcgggaagtcatcagagaaaatgcctggcagcacaaaggcggtatccagttcaccaccgagggacaatatcaacacctgctcacccttggacggtgcccaccatgatcgcgattgaccagcgcgcaacgtcagccagttcagccagccggtggtattgtcgcccgtcgccacgcggcacagggcttggtcgagatcgacctcggccaccgtaccaatacggataaggttgcgcagcaggcgcagaatttcagtaagttgggtttgagtgttcatgcagaaaggatgccgcccaacaggtcaggcggcaattcgtgcgggtttgttcatcgacaggacaacaggaacattattttgacaggctttccataacagcactttcgaccatggcaatatcttgctgactaaaccccagcaatggccgttcatcatattgcacatctttgctgtgcacgttcggacggtcacgcagaccaaaatgatgtactgccgccatccgctttacacgtccggcaaattcgaccaccgcatcattagggctgctgttcgctttcatgtaacgcgcggctcgtaacttgacaaacatttcacgcttaatgcgccctttgggtttacggacgggttgcgatttacgggcagcatacggggtgccgtcgggcgcttgctggcgtttaatgcgctgttgttggctggcgcgcagtcgcttagcaaccgtgaccgccagtgccttgcgcgctttaggtgacaggttggcaatcagtccggccagtgcatcatcaaagggtttcaactcattcatttaatctgttcaccgtggaaatacattgccgttggacgagggagcgcgcccgaccaagccggttcaggcgcatggttaacatgcagtgcgccgtcctgctctttcactatcacccgctctgtcagttgcaagtcgatacggatatcactcaacacatcactcatcacatcgaccttatgaataaagccggtgcggcgcttttcttctgtcgccatgatgtccggttgatgctcccgcagccatgccaaaatcggcacaaagagataatccacatcactgggaaaatcctcaataaacagtgtcagcgtatattgattctcgaaagacagcgacggggccagcgtcgagacaatccgcccaccgtcaacaaacattttcagccgctccgggttagtctgcaacagtggcagactgtcggttaaggcttggcgtagcagtttgggttttagcatagtgttgctcctgacactgtttaatggcttccacttgcagcccacaagccaccagtgcggtttctaactggcggatatcggcacttaaatcaccgttaaccgccgggctgctgcccggtagcgggcaactgttcaccgtcggacaaccaacgtaaataaccgttggggctggcgaacgcggggcgctggtgcagccggataacatcagcaggcaaagcagtagcgaaccaatcacgcaagactttattttcattaagtaacctttgtattttctgttcacgggacaatgacaacgtactggcgtcgctcagtgactggcgtaatgcccgctcattttctgcctgttgccgggcctcagcttgcaagcgggtgatcgcgttgtcccggctttcaatgcctgccgacagggtgccaataatccggttagcgttgtcgatatcgtcactcaggcgactggcataccaccccagcgcggccagtaacgtcacgatcaacattattgctgtgcgcatatcaggccccgctcaagcagtgtttttgctctgtaacacgacggcgctctaaccctttggttttcacgccattgacatagacccagcgcggcaactgattacaggcgctgtgccagtcactcttgttgacaaaaaatgccagcgtcgagcggcaagcagcgccggggccgacgttaaaggcaaacgacactaccgcgtcatacaccggttgcggcatggtcaccggcatacagacagcgatagcccgttcgacccgctgcacgtcagcaaccagattgaccgccacctgtcgttcactgatcacgctgcccggcttaaccccgaccgtgtggccgatgccatttgtccaaacgttggcgctgcactggtaggcgttgagctgacacccctcataatccgcaatcagttttagcccggcgggcgatgcttttaaggtctggtagttcggtaaggtggcggccagcgccagaatgacgccgaccagacaacgcttaacgattgagttcatcgaacacctcccgcctgacacccaattctttcagcaagaaataactcttgcgccggtagtaccagttgataagacaggtagccgcagcggccaccgcagccacataaaacgcgatatcttgcggactcagtgcgccaataaacgccaacagcagcgcaaagacataagctaccgcagagctgattttctccattttcaatcccataattgaacggtttcacgttgggccgccggggccatatcgggcaactccaccggatagccgtgaggcagaatggcccccagttccgacaagcccggatttgcgtcatagacttgctccagcacatcttgagtgcggccgtaatagcgccaacacagggcatcgagcgtgtcgccttgcaacgcgttgacctgcatcagataaggccaataatgctgtgagattttccggcaatgttgcgaatgctaatccgcgcatcacgccataactcatcaaccgtgctttcaatggcctccgcgcgtttatcaccacgggcgctggcgtcatagccgcgataacgttcggccagcagcgcagcagtaatggcacagaccgcgcgctggtattcggccaacaggatactttcgccgtccagttgctcggcctgcacctcagccagtgttttaaagccagcggccatctggtcacggcggtactcgaacagctcggcgttaacctcggcgattgcgcccttgatggtaaaacgcaggcgctcagcggtaatggttccctcaaggcgcagcagctcacgcagttttatcgggtcaaccgcaggccagaaaaaggtattttcaatcaccggttcggccgttttgtcgggccgtggcgcggggataacaacagtggtcatggcaacctcaatatcagaatgggtgggcggtggacgacggcgttaacacgataaaatcggttgcggccatcgtgccgcccggctcggggagcgctcgggttagcggctggcggcgttctttaacttcacggccagtcgctcaatgtctttcttgacgccacaaccggtatgcagttggagtgcgcggtgaagatgggacagggccagttcgccctggccactgtcacgcagcacatagccggtcattttgtgcagcttggcccgcacctgatcgggcatgtcttcgtcttccatcagttcaatggtttgcaacaacgggtcaacatcaaccggtttaccggtggcataggcgcgcgccgcagcgtccgcgacttcctcggcaattaggtaagccgtcgaacgggtaaagcggtctgttggtactaattgataacgcagggcataacgggcgatatccagtgcgccggggatatcccctgcatccagccgccaaatcatgatggtcattacaatggcgtcctgcgcgcctttcccctcactcaacacgccagagatccacggcatgtactccggcaataactgccgctttagctcggctttgcgctcgtttgaacgcacctgtttcagcttgcgcttatcttcattgagcttgagcaacatcagctcgtagcctgtggcgtggcgcagcgggttatcccgctgttgtgaagcggcaatagccgactgttggataaagtggcgacgcgcaggactggacatggcttatttactccccttcgcggctggtgcttcgcctgtggtttccggtgcgttttccgcgttggctgtggcttccggcttagtttcatccgggttagcagccacttttactgcagcaataatcgcggctgctagaccatcgtagttaggtgcgtcagacgcagcttttttatccgctccagattccggttcatcttttttctgtggtggtggcaaaatctcgatgttctccaccagacagccgcaggcgtaatcttccaccacataatcctgcttaatggattcgtagttttcgatgcggtcacgtttggcgttctcatcgatatgacggcggtgcgagtcttccagccagtaaatagacaggttatcgaggcgggtaataaagaacgcgttagacgggaagaacggcacacggatagccggtaaattaccgatgcgtttttggctgataatcaggtcagcagcgagggtttcgctgttttcctgctctttgttgacgatagggaaatatttatcctgcatcaactgacggccagtgatgaccaccagttccgggtcttcctgatgccagtcagcaatcatctggtttgtggcatccatgaccaacgcgtccagattggcataatcgccaccatggccaacacgaattttttctgacactaccgcgccatcttcatcgataactttactcatcacgcgggttggtgcgttgttgcggtatttctgcaaccagcccactgcgatatcctgcaacaatggattttgtacacggttggatgtcttggcgcggctgatgccgttgaagcccgccatgatgcggtcaagtgcctgtcgcttgataatcgcgtcgcgtaagcgggtctggaagtcctgataacgcgcccacaggtcaagggtgttatagcgaatgtggaagtcgtaattcacctgctcacagaaatacttctcactgtccagcccggcaaactcggcggtttcgcgctcgtcgccgctatcggtatccgtattgctggcaattgacccggtaacactcaaccccactttctcggcggtcagttctgataccggcacaatattgatacggctcagaaattctgaggattcttggacgcgggtcatgatggtttgtgtgacagagggttcaacgctgaattttttattcaggtcgccggtttctaccccgttcagctcggcttgacgggtcagataggcattaaatttaaaacgggttgctgggcgcataataatcctgattcagttaaataacgtgttaatgaaataacaagcggaccgcactgcaggcggccattaatcccaactagcagtcggtcaatacatcgttctggttgttgccgccggtggcttccgggcgctttgactgaccaaagttctcagtggaagaaagtttattttcgaggtcagttaccccttgtttgccctgtttgatgctctgcttcagctccacaacgtggtcagtaagttgtttctcaatgatggcaaagcgggcttcaatggtttctccctgttcctgcacatgcactgccacggcattcaccgcctcatgcacatcattaaaacgggcgtcgtcggttgcctgtttacgactgaataccgatttcacaatgccaagtaagctgacacccggctcggccacgtcttcaaattccagttgcacttcaaccgctgcagaaaacaggttatccgggtgagatttacgggaggccagtgggttgtgtttggccttggcgctgaattccagaatttcagtcccaaggctggcggggtcatcggtcaccgccagaccgaccagataagctttaccggtattggcaaagtttgggcggatctccatagaggtgtagattttctgacggtctttattcatcaacaccaaatcatcggtggggctaatttgcgcgaacagtgcacgcttgccgttcaggatagagtcgtcttcaatggtttccgctttcagtccgatcacgtcaccgtaccggcggaaggtgctgtccgggaagtagctggtcaaatgctccagattgatgcggcaaccgtacacgcgcgggtcaaatgactcggccatttggttgatatcgtcggcttcaatcttccgcccgtcacaggtgtcaccctcaacgccgatacggaaatacttagacactttcttagccatgtgtggctccattcatgtgattagggttgttcgttcggggcttagtctcctgatgtatggcggcagcaacaacgaaagccagttgtgacggggctggcacaactggcagggcgcgcagagggtcgggctggtcgcgtagcctaatggcatgaatacgacaccgagcaccattatcagcgacccacggcgacaggcggccttgctttactggcaaggcttttctgtgcgccagattgcggacacgctggccctgaaatcgccgactgtgcagagctggaagaagcgcgacgggtgggatgccattgcgcccatttctcgggtggaaaccagcatggaagcgcggttaattcagctcatcatgaaagacgccaaagaggggcgggattttaaagagattgacctgttaggccgccagattgaacggctggcgcgggtgaaccgttataaccagaccggcagtgaggccgacttaaacccggcagtggcgaaccgcaacaaaggggagcgcaagacgccggacaaaaacctgtttagtgagtcggcgattgagaagctggagtcgatatttcatgaaaatatctttgattatcagcgtaattggtttgaggccgggttaactcaccgtatccgcaatatcctgaaatcacggcagattggcgcaacgttcttctttgcccgtgaagcgttactggatgccatcacaacaggccgtaatcagatttttctgtccgccagcaaagcacaggcgcacgtgttcaaaagttacattatcgacttcgcccggatggttgacgttgacctgaaaggcgacccgatggtgttaccgaacggggcgcgcctgttctttctcggtactaacgtccgtacggcgcagagctacaccggcaatctctatcttgacgaatatttctggatccccaagtttcaggaactgcgcaaagtcgccagcggcatgtcattacacaagaaatggcgtaccacctatttctccaccccgtcgagtctggcgcacagtgcctatccgttctggtctggtgagctgttcaataaaggccgccgcaataaatccgaccatatccaactggatctcagccacagccatttagcccgtggcgcgctgtgtgatgatggtcagtggcggcagattgtcacggttgaggatgcactggcgggcggctgtaacctgtttgacctcaaccagctctcactggaatacggcccgtcagaatatcaaaacctgttgatgtgcgaatttgttgacgatcaagcgtccgtcttcccgttcgccgagttgcaggcttgcatggtggacagtctggaagagtgggaggactacaacccgtattcgttgcggccatttgggcatcgcccggtgtggattggttacgacccgtccgaggccaacggcggcgacagcgccgggtgtgcggtgattgcaccgccgatggtgccgggcggcaagttccgcgtactggaacgccaccagtggaaagggatggactttgaggcgcaggccaaacatatcgaagagctgacgcagaaatattgcgtggagtatatcggtatcgatgccactaccgtcggccaaggcgttttccagttggtgcgccagttcttcccggcagcaagggaaatcaaatacacccctgaaatcaagaccgccatggtgctgaaagccaagcacaccatcaataacggccgcctggaatatgacaccggccacaccgacatcacccagtcctttatggccattcgcaaaaccatgaccgccagcggcaaaagctcgacttatgttgccagccgcagcgaagaagccagccacgccgatgtggcgtgggcgattatgcatgccctgttaaatgaaccccttaccgcgacatatggcggtcacagccctaatttcttggagttttaccaatgaagccaatgacttttactgctggtcagcttgacggcctgcgcgaacatttcgaaaactcggcctttgattatcagaaaacgtggtatcacgtggggcagaccagcacagaccgcagtctcaccaaatcgcgccagattggggccgactggcttttcgcttttgaagcgttactggatgccatcaccaccggccgcaatcagcattttttaacctgctccagaagtagcgccctgaatacccgcgcttatcttgcagagttttgtcgggtagttggggtaaacgtgagttcattctcgccaagtaacatgttgctaggtaatggcgcgctcatcgcctttcacggggaaaacagtcacgccgccgctcatgctgggaatgtgtacctgggtgaatatgcatgggctaaaaacccacgttcaatactgcacatggctaaggggatggcaatgcacaaaaatcatcgtttaacactctacaccacgccctcccactcaaataccgcgttcaagatttggaacggctcactgcgccgcccacgaaaagtagcaccggtgatacacacggataacggcgttttttgcgctgatggcgtattccgtcaatcggtcacggctgatgctgccattcagcaaggctgtacgttatgggaaaagaactggggtaaagattggctgaaaaagcacatgacaatagatgatttcaatctcttatatttatgtgactggtcacaagcggcaagcaatgcaggggaagtaaaatgagtaaacgcaaaggccgcaaggcattaagccgaccagcaaccaatcacaccgccagtcaacagcaaccggtggaggcgttcacttttggcgaaccctccgccgtgctcgataagcgggaaattctggattacatcgaatgcaccggtaacggcaagtggtatgacccgccgatcagctttgacgggctggcgcgcagcttccgtgcggcggtacatcacagctcaccgctgtatgtgaaacgcaacatactggcaagcacatttacccctcacccaatgctcagtcagcaggcttttagccgctatgcactggattatctggtgttcggtaatgcgtttttagaagtacgtcgtaaccagttgggcgcgccactgcgcctcgaccccagcccggccaagtacacccgccgtgggttagagaaagattgttattggtttgttcaaaactggaaaaatgaacacctgtttgaaaccggtagcgttttccatctgatagaaccggatattaatcaggagctttacggcctgccggaatacctcagcggcttaaattctgcctggctcaatgaagcggccacgctattccgccgcaagtattaccagaacggtgctcacgcgggctacatcctgtatatgactgatgcggcgcaaagcagcagcgatattgaggcgatgcgtaaagccatgcgtgacactaaagggttaggcaattttcgcaacctgtttatgtacgcgcccaatggcaagaaagacggtatccagattttaccgttgagcgaagtcgccaccaaggatgatttttttaatatcaagaacgccacccgtgacgacctgctcagtgtgcaccgggtgccgccacagatgatggggattattcccaacaataccggtggtttcggtgacgtcggaaaagcctcacaagtgtttgttcgtaacgagttaacgccgttgcaagaacgattgaaggaggtgaatgactggataggggaagaggtgatccggttcaagccttatgaactgataagcgaggaataataaccataggccgccgaacctgacctgacccataaagttggacggtttacaggcggctttttcacgcctgaaaagtagcaattccaacacctcgcaccacaagccaccagacgcccgtcacgccctcacaccccacgaacacgcattgactccccacccaaccgcacgcaacaccacggaccacccaagtactacgaatagggggatcaaaaccctttgcgcgcaatgctatccccgccacgcctgcgcgctttgcaggtcgcttttcatgcacctgcatgaggcatcgaaaaccgcgccgggactggggcaaccaaggaaaatagaggggaggatcaacatgcggaatcatgcactatatgcatgcatgacccaaatcacgatggcgggccacacatgcatcgttttatggagaatttattagtgtgattttttgccgtcggcgttatagaaaatctcatcataattttggctcgtcactatctggctggtcaggtctgatatcaacgacatggcgacaagaaactcactattactgcactgtgcaacttgcgaaacttcagcaataaatttaattcttgttagcattagttctattttttcaacgtgttccatgcaggctccttattatactgtatttatatacagtattcagtaaaagaatattaaggtcaataccggatacggctatttagataaatcagatgtttgtaacacgctatatgttgtaaaaataaaccattgtgacgcgtcacaatggtttaactgcgctaagtaataggctgttgatgcctttggtctgccagcacgccgtctcaccccgtaaacaacacccatttggatcgcctggtaatgtgtcgccacatttgccacagcgttgtttatccagttcggccaactgctcttttagtcgccggttatcttggcgaataagcagcgcaatatattccggtaaatcataggcaggtcgaaagagacgccgggcgaccatgccctcggtcaacatggcgtattcttctggctccagtcgggcgcggatctcattgataccagcagatttatcacgctggcgctgtgcctgtttgcgagtcgttgcagcggttttagtcatggttttctctcaggtagatagattaatcatcgaattccggccagtcggacaaggccggatattgaataacggtgtcgttaaacgtcatttttgccccacgggctaacgattccagttcccagcgttgggcgctgatatctttcagcagtaaatcattgcggatttggggaatgcgctggcgttcttcacgggttaaacgggctgatggggcaataaggcggcctttggtggggtcatagcttcgttgtatcttgctaatcgtcggctgtttctctttaacacgggccacaatcgccctcacggcggcagtgtccgaccagtcaataacgacatccggtgagtattccatcgccatcacaggcgttttagcctgcccgttggggtcatttggcgcttgggtgtttccacctaacccacagttattgacaggactccgaggcgcgccagatgcgcttttcaaagtcaaaagctcaacgtcaacggcaccagcaacgatgcgccattgggttgtgcgggtttcatgaatatggtcagcgcctaaatgcggcgcgtagataccgacgactttctgtacttcttcatcgtaggcgttgagttcatcggcgacgcgcttggctaaacgaacagtctggttgccgcaattggtgccaccttgcgcggcgatgtaggcagcaaaatcaccctcgtcagccgcatggcgcacagcttccacggtttcgtcgaaagtctcagccagactaatagagcggatacggcgacactcgcgatagactcccatggagggaagcccaatcgggcgaaattgagggatgcgccacgttgccgcccacgctgttaccgccgcagcggagtcagtcagcagctcaccggtttcatgatcacgttcaccctcaagcgcatagccgtcgatattcttggcaatgtatttagcgatgtagccagcggccccgcctttgttcatgtgcttacactcaaagcggtatttagcagccccgcgctcgtcaccatcttctttcaacgcatagcggctcatgatgtcgattacctgctggcgctggcggcgttggcaaaacagcatcatgtgccagtgcggcgtaccgtcatgatgtggctcaaccacgcgcattccgtagacgcttaattcgttgtctttaaaggcggtgcgcattttgctccaaatcttgcagagatagcgctggccgtctttgggtgaataggcttcatcattccacttatgattaagctgtactttctcgttgtcgcctttccccacaacgcgagtcgggtgatattttgacggggtggtgatggtcaggaacataccgacgtgcttttgcccggcagcatatttttccgtgaacgcgatggtgttcattaactccatgcggcgaatttctggattagaaatactcgccatcaccttatcaatcaggtcgatgcgctcaccggtttcaatgttttctaactggcagcttttgagatattccagattagactggcgacgcgcaaacacctcacggatagcctgcttactggcataagaagacgctgacttatcacggctgacattaccgacagcaatcaataacgcctcccgccagcgtgttctctgcgctttgagtttgcgctcccaccactcagggttaaccagccgtgacagactggcgatagcagacgtgatatctaaccggcctttcagatatttgcgccagtgcattggggtgatattaaaagcgcgcgccattctggcaagatcgccgaatatccgtacctgcgtatcggcctgcaataaaacggccctgtccccctgattagccttaatgcattcatcacagtgatggttgtacgccaccattagctcatcaccgattttgcgggcaaagcggcgcagctctttatcatgcatacccgctaagctggcataggttggggcatcagtggaaaagctcattgatgcactgaggcgcataacatttttactattgaccacctgaatacgcggccagatacgctggtcaaagacaaataccagccatttattagcgtcgtttagccctttgttggctaacaggtattcatagcgagaaatgaactggctacgcaggaagtgaggcagattattgatattggctaaaacagcttgcccctgaatcagttgttcacgggtaagcggtcttgctggtgcgagggtttggcgtggtttgctgccggggtaggcgtaggcaggaacagcagcaccgctgcccggataaggcaacggcggagttggggtaatacgaccacgcatattattaatgctggtcataagactgagtgattatgtgctcagcgatttgattaagtagttcagcagcttctacgccatttagttcacgattcaagatttgattagcgatttcttccaaacgagatgaaaccagtgcagcctgattcgttctttcatccatgcgcgcttcattgagcattagctccattgattcaactgacgtcattgttactgagcggtcactgcccggcttgccggggtctacgcccatccatatattttgtgttgtattctgcatagataattcctgtttttaggcaatacgaaacccggcgagtgaaacgctatatattgcggttttagctaattaataatattcagagtgcagtcatcattactgacaaatgacggcaacgaacgagtaaactcaattaagtaattcaacgcttcaacaacagattctctttctgctggcgttaattctgaaaactgcatattcacatgacggctttttaacccagcatgaaaacagattgttttacgcaaatgtgccggtgatttatcaaaagcctcctgagcaacattctttctattacggaaatgcgtttcttttaattcagcaatacgagcaatgcccgtcattctcaattgttcagcttccgttaattgcagcatataacccccaatcaacgcccgagcagacgacgtaatattggcgtcttctttgcagaggacaattcttgtaaaagcgccttttgattacttcccggcttccagcgctggccgttcttcaactccagcacaccattaccgaaatggcgcaggtttaccgggctttgctgttttaacaatggggcaatagaaataatcataaagacacctcaactcaaaccagcgacagcactcaagccgctaataacatcaacggttgaagcaagcgcgggggttgattgaatgcgcgcctgcaccgtcaggccaatcaatgacagatgacgaatcgcagtattgacgctatccaacagtgcagatttgctgaatgctgttttgtgattgccttgcaccgcagcggcagcaatagaacccacggcggcagtagcatgtagcgcataagtcgggatattgccggggcaggcttcattgactggcacagatggcatgcaattgatttgtgacagcagaccgtctaataacgttgggtcttcggtctggtcggtaatgcgtaatagctcgtcaacggtcaaacggtgcggctgatcggggttcaatttattccgtagaacctgcgccgcaatccctgcgtttgctgccagctcgactaagttgtgctttaacgcaaactggcggcaggcgttatcaaagtgcggatgtttggacactgaaaaatcaaacatggcttacttcctcacatatgccgacaattagttggcaaatttgaacatcgaacattactggtttgccgcttctttagtgagagcgatcatatttacgagaaccttttccattttgcgaactttctggcggataggtagacggccatctttcaccatgccacggcaggtttcataagggattccgctcaattttgagaactcagttagggacagatagggagacataactgttattgcaaggttctgattcatagggcatcctgtttgatggtggttaatataggtattggtgggtatttgccatcaattcacgaattaaactatgcatatgcgagtatgtaaaggggtttttgcgagcgtggatgataaaaaacttagcggcgggattgcagcagtagaaagaatgatgcaagcctatggttttaaagtacaaagagaattagcgacttatctaggtgcaggaacgggaacaatcagcacttggatcaaacgtgattactttccgggcaaagagattgtgctctgtgctttagaaactggtgtttcattacattggctcgcaactggtgagggggaacctcaggaaccggttaaacctgccgcacatgaaaccgcaaaatctattgctcataaaagccttgaagatggcttgctgatagatgcatcccctgtattgcttgattcagaattattgcctgttcagattgttgaacctgaattaatttcgttccctaatgagaaacgctattttctggtcgaacgccaatttaaaaatgttgctgacggcctttggttgattgaaaaagcaggtgtgacctcgattagcaatattgctcgtttaccaggtgatgtatggcgaatcaatgatgtcaattggccggttagtgaggttaatatactggcgaaagttgtcggtgaaattacgggctattagttctagaacagttattaaggaagtgaaatgaagttacataatcttactgttagcaaattatttaatcgtctagattatcgcctgtcatttgaaaatgatattataactataataacagggcctaatggttatggaaaaactatactgttaaaaataataaacaatttcatgacgaagaatctaaagtttttttttgaaattaaattcgatttcattgaacttggattctctgattttaatattagattaactattgtaaataatatattaaatgtggaaaagatagatttaacaacaaatgaagttaatatttataaatttattaatgatattataaatgaacgtgatttcgttgaagcatttgaagctcaaaatggaaatttagtaaaaaagaggtttataaaaagaagtgttaaaaatagtacctatcttgaagaattaaactatgatcttggattagagcatattgacgatcttaaatggctagataaaatcattgaagacactgaaactacttttataaaagctcaacgattggaaacatcaagtaatagtcgcgacatggggaaaagaacggaactaactataaagagtttttctaaagccttagcaagaaaaataagaagagcctcaatgatatcttctaatattgctcaaaaattagattctacctttcctagacgcctttttgaattttctcaagaatatagaacaccagattcaattgaagatcgcttgttaggcttacagcgtacacgaaacaattttataagttatgggttacttgaatctgataaagaaaatgactctcatattcctagtcatagtggtttagataaagcctatatgagtgtattaagcctctatattgaagatgcattagagaaactaaaaccatacaatgagttatataataaagttgatttatttgtttcattgttaaatgaaaaaatgttggcatttaaaagtgtaaaaattagtcatgatagaggtttttacttcattagcgatggtggtgaagaaatagaacttgaaaatttatcttcaggtgaacaaaatcaaattgtgctattttatgatctaattttcaacactaaagaaaactccatagttcttattgatgaaccagaaatatcattacatgttgcttggcaaaaagagtttcttgatagtttgggtaaaatattaaaagttaatcatatagataaagtaataatcgccacacattcaccacaagtcattaatggtaaatggactctaaccattgatttatttaaagaaatcaacggtgaacgataatgaactcattgcaaaatactttatctacagaggattggatcgatacaactattttgttatttcagcatccaaagtataataataaagcattctttatagtcgaaggcgatagtgatgttggttttttcaaaggtatattctcagataaggaattgcattttgattctccgtgctgtggaaagcctgaagtgataaaggctgtatataagttaaggggatataatcatgaaaatgtatatggcatttgtgattcggattttgactttatcagtggaaaaataaaagaatacgaaaataaaggtttaattttcactgattatcatgatgttgaaatgatgttggttaactcaaattcatttgataaattctatcatgaatttactaaacttgaagtttgtaagcacaatgagattagtagtgatgatgtgaaaaataatatttttgatgctgcttataaaattggactattaaagtggatcaactatgattttgggttgttacttaattttaaaagtatgagatatgcggattttatagaggttgaggatttcagtatttcattcaactttaataatctacttcactcagttataggtagaagtaaaagtttcacaagtgcattaagcattgaggaaattaaagtaaaatatcgtgaatacgaaggaagaaatgctgagaaactccatatttgtaatgggcatgatttttctaacatccttgctttagtatataaacaagagttgtctaaagacagaaatatgaaccaagacagagttgagtctcatttgagaatggggtatcccaaagaaatattttataatactgacctatataataacatgaaagaaatatttacctcatacggagtcgatgtgtagtcacttgtaatttaatttacaagttacacgattttgtttgatgaaagtaaaatcaaacattgactactgtttttatatacagtaaataggcccaagggattattcttgaggacttatttatggcagtacggaagttacccaacgggaagtgggtctgtgatttttactcagatggccgtgacagtaagcgggttaggaaaacctttgttactcgcggcgaggcgatgcgctttgaacgtgaacaattagcgcaacgtggtgatctggatattgactacacaccggcagagactgccgcgcagaggttaaaaacattggtcggtcagtggtatgaactccacgggcgctctttgagtgacggcaaagcaagattagataaacttaatatcctgtgtgataacttgggcgatcctgctgttgctgattttgaccgggaagtgttcgccaaataccgcaagcagcgtttagccggtgagtttagtcgtaagccaaaacacggaatcgttaaaccgccaaaagaggcaacggtcaaccgcgaacatgcttatctgcgagctgtctttaatgagttgaaaaggctagggcattggaatcatgcgaatccgctggatggcgtcaggttatttcgtgaaagtgaaaacgaattaactttcctttatgaggacgatattaagcgtctgctgcatgagtgtgacagttccagcaacaaagatctcggcataatcgttcgtatctgtctggctaccggcgcgcgctggagtgaagcggagcaactaagacaagctcaggtgatgccaaataaaattacttatatcaacaccaagagtaaaaagaaccgaacagtccctatttctgcggaattgcataaacttattccaaagatgaaagggcgcttattcgccaatgcctatgacgcatttgggcaagccattgaccgggctaaactggtgttacctaccggccagttaacccacgttctacggcatactttcgccagtcattttatgatgaacggcggcaacatattagtactacaacaaatcctcgggcactccactatccaaatgaccatgcgctatagccactttgcaccggatcatttagaagcggcagtgagtttgaatccatatgaccgaatacaagactttaaaaagataggaagaaattatatatgaacaaaaaatatcaagtttttgtcagttcgacatatgacgacctgcgagttgaaaggcaagaggttattcacgcgttacttgaacttgattgtattccctccggtatggagctatttcctgcggcagatgatgaccaatggagtttaataaaagatataattgatgaatgtgattattatattttaatattaggtggaaggtatggttcattaagccctaagggtatgggttatacagaaatggagtaccagtatgcattaaaaacagaaaaaccaataattgcttttttgcataagactccgaattctttgccgaaaatgaacactgaaaacactcccgaaggtacagaaaaatttcaagtatttagggagttagttcaaaacaagatgtgcaaatattgggagtctgctcaggaactggggtctgtggttagtaggagcttagtttcattacagaaacgaaatccaggagtcggttgggttcgggctgatttagttccaagtcacgatctgactttagagatattagagcttaaaaaagagattgaacgtctcaaaactcagttagatgatgaacgaacaaaagccccagttggtactgaaaaactggctcagggtacggataattttgttctaaactataaattttcgagcacgactagcaaaagttatacctcacatagctggaatggagagctacacgtaacatgggatgatattttttatcaactttctccattgatgattcatgagtctaatgataggcaactgaaagagtcattgaatatctatactagaaaattaggtttggttgaactcgaaaaagataaggatttcagaggtcatacatttagtagtttttatttggatgaggaagattttcaaactataaaggttcaactaagagctttaggattaattaagaaaagtgataaagtcaggtcagttaaagatataggaacttattggagtttgacagcttatggcgatagtgtcatgaatcgtcttagagctataccgtcagaagttgacccgttaatatgattatttaaggctagaataattgctaataacaacattcagaaaatgaagcaatgaagtgaggagaattttaaatcaaggtgactaccacccccgcaacaacccaaactaaccctccatcgtgtttggtaacttactgattttacgtaagtgattgatttgcagattgtcctaatagtttttaaaatccctcggcttatggctgtgcgggttcaagtcccgccccgggcaccatggaaaatattctaagtaaaacaaagtagtacgagtatgtcgttaaccgccgagaggcggtttttttgtgattaaaatcccacttcaccattgtttcgccatatcacttcgccatatcttgacctcccaccaccggaactacattaatctttctatcatatcgcgctgtctgtgatgcgtttttgtgtcctgagattgcctgcttgtcatatagcgaaccagttaggtctgagatgccttttgcttttagatcgtggaacgtaaaattaaattccagttcgggatacttcatagttgctgccttttttgctttcatccagtgggcattaaaactatcacgggtgaaacgtgaccctgattgctggtgtaacaagtagatgctcacaacgcccctgtttaaggggagggtgcttgctagtcgtataacctcatgcaaccgaggtatccaagctttaatttgggcaacgccagttttgctttgttgtataagtatgccgctctccagtaactgccctttcttcatgtccaaaatatccgcttgcctggtacagcataagtaagccaactccatggccacttttacgaccgatggggcggtatcgtaaagggcggtgtattcttcatcggttatataacgagttctaactttttctttaaattgcttgaccccctggcaaggatttaactttactttcccgcgctcatatccccagcgaaaaaccctcgacatgaaggatttttccctgtttgcttgaaccctgctttttgctccacgcttatccatatactttcgaatatgctctggtcttatattgtcgggagacattttcccaaacactgcaattatttttgatgagtatttgtggtaatccttttgcgtttcggaggccagttcgcagaaatcacctgacaatagaaactcattaatcaaaccagtaaatgtcgaatcctctttttggttgatcattaatttctcaaaagcaacccagacatcagcctgactgcattcaaaattacatagacggattgttctcccgtctattgccctgaattcatatgcagacttgcctttacgaacccgtggaggcatccagttatctgcagggttcttgcgtggacgtgacattaaatagccccataattaggttggtcttcaggcatgctatgaatgatattgcgggaagagatagggtgctcaacatgcgcccatgttgtgctaggtctaccatctttacgctcgatgaaaaaaatgccactttcacgtaagcattcacactgtttcttgggttgtacaaaaccagtgatctcttctaattcagtgcgagtcagtattttggtcattggtctttcctcagtaggaaaggacgcaacgatgctgcgccctattatggtcgtttggtctgtggtggtaaggggctatgttttagtgatacatctattgaatattaatacagcggcgtggtgtcaatcgtggtagtggaaatactggtattaatatcgccctcaaatatcggaagaacaccaacatttggtgcccagtttcgggctaattcaatgttatttgtttcgtgcgtataatcctccgttctccagccaatcagctttttactgatgaccccgccaaccggcggtaacgctgccagggcctctaatttcgcatcacatttatacatttcatcacgcaacgcttgagctgctgctgtcattgcagtaagttcattgctctgtgatttgtattgctcacgcagtgatagaatctcagtctccagacttttcgcgtaaccctgccaacttgataaaaactcagaatcacaacatgaagcacaaatacgcccactgtcggcgcgtggaacagtcatttttgtgtgactgcaaaaatcacattcggctactactgctgaatcccaattgtgccgaattcgtaccggctctttactcagcatctgcattcccctctccggcctgttgtacggtcagaaccatgtccgttaagtcatctccatagatgaaaaatggttctgtctcttcgtcgatgttattcatcaatattctccccagcgatacgtcgaggctacttctccagcttcttctgccgcgcgaaagtctttttcgggaacagatagaatgttgctaaaactgttgaattcaccgtctttactgatttcaacaaaaccagcctcacctatccctttaaggcaaagcgacacggtttcgcttgttagccggattcgttctaactgatattgtttgcggtaaataaaagcctttaatgcttcttcttttgtgtagtgatagcgggaacgggcagcatttttaagactgcgtttaacttgacggttccccggtctaccttgatccttgatatttaataatttgctcaagactcatgttcgggtagtcagggcagtaccaaaatgtcttttctgtctcccgtagaattaccatttgccacagcattacgattggtcggcctttcgagtcattactatctacatagcgatagcagtattccttatctgacattatgctcacctcgcaggttggcggcgaactgtattaagtcagctttgatatataaaagagacttgatcactccatcctcttcaattgcagagaataccgacttgtggaatccatccgctgccagttcaactccctgcgcctgatattcattaattacccgcgccgtttctggtatttgttgcttaataatttccagtgcttgagtgtgggttaaatacccctcttgctgacttttggcccattcatttaattgtgtgtctgattgataggtaggaatatcaatatctataccctccatattttccagcaaccaatcctttgcgctggtaaattgcccggcgtgaataagtgaaattgctgcgattgaaccaacaactagccggttcatgatccacgctccggataattcccgcgctgctttttcttgcaacaccatgttttcaatagccaacatttgattctttttttccagatctgcaatagtatttttagcctcgtgataaccctcaaataccactggtaatagctctgattccgtcagaagagcattaaatttaggatgtgttgcaacgtggtcagcatctggatcttggaaattatatatcagggtgtcataagcccccatgaagcgtccaaagccgccgtggccttgtaccagggaatcccacgcaacggcaataaatgtgcgctcctcgtcactgatttcttgatcgtcaaagcgttctaaaaattgcgcggatgattctctgtgccagcggtcttctgctgcttcagtggcgtgaaagagttgccacagagatttcacttcatcttcactgggccttgccatttttaccgatattattttgctcattgctttatcctcgccattaaaacgccttcaactggcaaacaaacatattcaggcggcaaaccttcttgctggatgtcagcaaggcaattactttggtcaggatatatatatccctgtgattcatatttgcagggctgaaatgtaaaacagacgtatagaaacaatccaaacatgggattactccttgattgattgattgattgaataaataaatcccagactgtggggtgatatataatgagtaatgactgggagttgagagggtggaattatttaaatcgattaaaccaagtatttactttattaacctgctttttaacagtaatgacatttgggtgctttaacttagaacctttattcacgttcccttcttagctctatgagcgccagttattggattgataaccacatcactttctaatggcctgatacggatatatttacggggtttatttttgaggtaggtcagcttaccgggggtgaaaatggcaatatcatcaatatcaaataatgctgcaatcttcctgatggtttcctgcatattggcctcggcagcgtgttcccataccgtcgcccggccttttgcgattttcatggtattggctcaatatcgccaccatgctcttctattgctttttggagtatccaccactcccggacaataccaacgagcatcaaaatcgatttcacctgtacagctaagcggataaaaatcatttgatggctgaatcttcatgatccgccgcgtctgcgtcttgcgaccatctaaaatggccttaaccatgtcactattaaataaaatcggcctttctttgcattgaccggtcataactaaacctcccgtattaatcggttgataatgtctcgtttggaggggatgcgaagctggtgcgccagttgccatgctttgcgctggttttgggttttgtgctccagcattttgcggatagtggtcaccggaataccggtatcgctggcaatcaagttttcattgtggccagcgcggtgaaactgataaatagccaacaaaatttccaatgagtagcgcttacgaataccgatatcgaccgtatccacctggggtaagccgcgccatcgttcatcactgtgataaatcggttttggcattggcaggtagggattcccgctgcggatctctgcgcggctgcgcattaaccagattatgcaagcggtgtggtctcctctgtcatcttccttaaaataacagccggtgctcaggtttagttcctcatccatcatgcggcttccttctgtttctgctctgattcccactcttttacgattcgggtgcattgagcatgcacttggcgagcgcttgcgatcccgaaacctttgactgcattagccaacatgtcaggcgttcggcgaacaacatcaaacaatgaatggagcccagagcgggccagcagttctaaatactgctctttcaaggggagagtttcggtaagcacagactctgcccattccgcccgcttaaccaggtgcgggtgagttggttcaagcaggtcacgaatgcgctgtgtaacagcaggcgttaggccatccggccagttccgtttgaagtcatcaaccatggggtagaccggcaatgcccactcattaacagagacgatcaggccaatacccgtggtggaacggatttcaatatgccagtcaatatcgttaataagctgcatatcataatcaccagagcggagcttcaacccccactgaaaggtgtaaaagtaaaactcagtgccatcattaccacggtaataagtgggctcgacgtccccatccatgcgctggatccgtgcggtaaggtctgaaacagtattagccagttggttgttaacattgaccatggccgccagtttgctggttctttctgccgcctcttttttataccgccggatttccgtcaattgctggtttaacagcgtgcgcttgttgtccagttcatctttcagccgcacgatttggattttcattttttcagggttaagtgatttcaaccgattcacttcagtggccaacacgcgttgatcagaaattgaaaggttgtatttggctgaaatactgtctctctgggcattcgcttcagcggctaccaggtcagcgctttctatgcgttcctgtacatgcgttaatgccaaggatttcgtggttaggtcgttctcagctttctctaaacggtcgaataaaaggttgtattcgtcagtctcgatattgagttgttcaatacatagggactgtgtttggttgagtaaaacagtagcgctctcgatagagcgctgtgcggtgccggtagtctgctcaatggcaaggtctaactgcgcccgaactggacgcagggatgactccagcacactggcagtggtggcctgtgtggtcatgattaattacctgtgaattgcctgtcgaggcaggtgatgaaaggttactgcgtgatagagaaatagcggatccgaccagcttttaccgcctggtacaggcggtaaactgtttcagtagtaagatcaatgcctgccgtaaccaaatcagcattaatctgtgcaatcaggtcaactggcgttgctatttttgtttcatttgtcgttttacccagttgttcagggaaactcactgctcccgcggggtgcaacggctgatgggcagttgtagcagtgcttacagcgacgatttcagttgtgaccgctgcggcggccagttgccgttttttcaattcttcctgttgttgctctgcttgctgtctctgctgttcctctatctgtttttgcctggtaatgcgttgctcaatcatcagcgctaaatgttcatgctcaaggccgattatttggttgatgtcagcaaacaggtttttataagccggttcaatatcagtaaatagcgttaaattggcctgatatttttcactcacttgattagcggctatcttggctcgggccagttcatcgttggcggcactttgcaaagacgtgagggttttcttgcctttgatggccgtggcaaagtcagccgggatagtgggtagagtgacaatcgccaactgtttattgatactggaaatgtgctcggcaagagcggtttttgccttgttcagtatctcaaggcgaatagcctctttgcgcaacttaaccagtttcgacaggtccagccgcttgttacgcatttcatcacgcaaggtatcaatggtgcggaacagcagatcaatctgctcagttttagacagcgcctgctgcttaatcagatccagttctttctcggccttttcacaaaacttaaccgtttcttctgcgtcagcgaagtcctgatcggtcaccagattagtattgatagattgaataaaggccagtgcctgattctggtagaccgccaagtttgactcttttactgcgccttcgatttctaccaataaagcggggaggcgcatcaaggctttgccttgcgggatatctttgatctcaggggctgtgtaaccgtttaaatcctgctcaaattgctgccaacctgccatcaattccttgcgccgcccgcgtactggtaaatattccatccagacaaagttttctttggtgccatccgatactacaaaaatgattttttcagcatcacttacggcaagttgttgctccaactgccagtaatattctggcggcaaatctttatctgctactgcttgcgccagagtggcattccacattttgtgttcgaacagcacatcttccatcatggtcataccatcaaaggaagctaacaaatagccatcatcatcgatggccgtggctgggaataattcggtaccgataatggattctacgattacccgcgcagtggcttcctgcgcgtggcccttatcaaacaagtttgtttgtacccaatcgctgatttctcgttccgatcctgtggccttcatgttcagcaattcatcccggcgcattttgctggaagttgccatcattactggggcttcgctggcggtaaagtggcggctacgtaatgtgtgccattcttgcgtaccttgttgaacattaatgatttgcatcttctgcctccagatgttcgattgttttaatttgtgccggggtgagggtgtatttactttcgatggtgttgatgatttgcgtagcggttttcttgcccttattgatcagcgttgtccaatcagccagagcgcgttgaaattgttccgcgctatattctggtagtgcttgcggttgggtaggttgttggctgccctggctgtgttctttagtttcagtcacatcaagacttttaccctccatctcttccgctgttggctgctgaccaatttctggccaccctttacgcaatgcctgcgcttcggcacatttggctaattgcccataaggccgctttttccacatagcattgggtgcctgggtatcacgacccgcggtggcatagttttccagccagtactcttttgcgctgaattccacgatagtgccgttaggcatgagtttgctcagtgtgtatttgcaccactgagggaaagtgatttctactccattaaaggcttgcgtcagatctgggccaaattctggctcttgcgctccggcatagttaccggaacggtcagcctgtatgcgatataagccaacgccgggcatcaccacatcgcgcatttcatatttaccggttagtgcatctttcacgctcattggcactaaatgcacgggtttcatcagcggatctaactggcgggcgcggcaataactcaccgccatgatgactgaatcatctttagcgccagggtaaatactatttttcagtgcgttccaggtgggttcatcaatattcaaccccaccactgcgggtggaagattggttgttactgcttgagtggtcattggtcagtcctcaaattttgacagcgatagcaagaaacatgaacgcgcctaaaacgcatgcgaagaagaatttcaggccagactggcggggatactggttaatgtcgtcaccagtcacacgatggcgatactggagtgtcttgatgaattcaatagtcatggtatgctttcccatggttgggtttggtcactcaaccacgctgataataatcctcgtggttattgttcagtcctcagtaggtttgcggttggtcccgcactcctgggatagccccggcttaatcgctggggcttttctctttattggagtaggtggtctttctcagcgtctaattccattgctcgctcggccttggcaacccggagaaatatttcctcctgtacctcatccagataaagttccatagcggcagtttcggtaagtaactcaaggtggccggtactcgctccagcaacaaaacagctattttggacagcggatttaaaggcgttgagcatttttgaattgcggcgtagaaactcaatccgcttgtctaattcctcttgctcgttgggatccgacagtaatatgcggtcatactgttccagcgattgctcagccattcgctgatagttgtattcattcacgatgcacctcatagatcaggttggggagtggccttcacatatctgcttcgcttgctggcactgcttaatatcaaaccaaccaaagtgacactgctctgtggggatctccattttcgccgctaaccaaccgtatgcttgagagcgggacatatgccctgagcgccagatattttcaaacggggttttacatgattttctggcttgtcgggttgccttatctgccagagtccctaaaggaatagcagtgaatggatgtaggcccacatacgcaccacagccttggcataaatagacgtaaggccagtcgctgtagtcgcggccatagacttgctggtgcgtggcgacgtgaacgttacctgaacaaaaaaggcaattagtaggagcaggaagggggtttttcactcgggcagttgcggttctacttgggttggttggagtcttaacttttaatgtgtccaatatactttcctcaatggtcttcatcttttccgttacggggaatatctctattaacagatacaaatccctatcattgcgtacgacaatccagatggagcatctagcggatttacttcatttaggcttttccggcataaagtgcctctatagttaattgacactttgtcaccatcaataaagataatcttaccggttacggacgacatgcgaactgaccgaccattacttgatattttggtgaattcaaccttgtcgccaactttcagcatcgaccgatcaaattgcttaaatttattgcacttttcgcatcgatacttactggtgctcatagtcttattccttatcggtagtgaacttgccgaagccctcgcgcgcaagggcagcagtaaaatcacttactgaaggattcagttacgcattcgttagtaatgtaaccgctcaaacaccagtgaaccgcaacagcgatagggcgaaacgataaatgcccaacttccttgcgagaaagaatgcgaacacgaccgtaaccaactgtagaagcgccgggaacaaacacttttcctaaataaatctttttcatatcggtagtcccagaaggtcgtcatccgtggcgcggttagtttttaaggtcagatgacggaacgtgttctcattcaattatgagagctaacctttttgcagaggatatgtgccgctagtggtgggttgcacgcaaagatagcggtgatttgggcaatcggcatctggccggtatgcgcgttcatcaggttagccagtgcgtgcgctttgtcgagtgcttcggcggcttgctctgctttcatctgagcttcgtggcggtctgcggcgttgattgagattaaagttttcatagtagttctcagtgagtggttttgccgaagcccccgcgtacaggggcagcggtaaaaccacttattcgtcgtctttcttttcgttaatgcgttggaacggataacgatcggtatccgctttaatattgcggtagaagtgggagccaattgattcggcaccagagaacgctgcgtattcatcagcggatacatttttgtagtgatagagcgcagcaggttcacctttcgacttaaagcgaatcgccagagtgttacttaccgagtcatggccgatgctatggatctgggaagattcaatctgctgcatgttaattgctgataatttgctcattttggttccttaaaggtaaaaaaaagagccacagcctaagctgtagctccgatggtttgactttgctttcttgatagttaacgcctaacgcacgccgcgaggtaactgactgcaaccacgcatcttctggcgggcaactgctgcaatgcgtttctctggatctgctgaagtgcgggacttgttggtgatggctggcatatccggtatcagtttactccgcaccatcactaatactgctctttcaacacggttagttccccgatttgccagtgcctggatatgggcattacgtttttttgccatacgtttttgacgagatgtggtggccattggtcagtcctcagttgtgtctatcaccgctataccctcatggaaggcacactggtaattcgtggtttagctgagccgtgaccggtacacgcggaccgttttgtgtcacttaacctgtttgttaaagagcgtacccattgtttcgggtgatagtcctgttcttggatttaaatgtaactatagtttcggattgcgtcaagcaggatctgatactttagtttcggatatggttgtgaaaaaccattacatgtggtttttctggaggagtgaggggatattagcggacggctgggcagtctgatttgttaaaggtggcggttaatgtttttgatgggaattggtaaatatagttagcagcgccttgatatttatcgataagaatattgtcgcatagtgcatgggtaaaactttctttagcaatggctttaacatgtacaattgtttcgtaatcaggactcatatcattgattttatatatgtaattaatgcttttgtctttgacaaacatatcagttaaaagggtgttgtcatccaaacgtctagggatgccaagtttaattttttcttcagcaaatgcgggtacggctttttcccagattgaggcattatctgatttatctgttagcgcgcgacctagatctttgccaagaacagcaaaaatagtggcaacaatgagaataatagctctcgtgccccattttttgataaaagccataacgccattttctgttgtcgcgataggttttgcatcaataatggtttgttgtcttttaggtgaatcactgacccaagggtctgatggctttgcctgatttaactgatttacttgagttccacaagatgaacaaaatttgctatgtggctcaattgatgcgctgcatttcatacaatacattgttttttccttataaattttcccatttagcctcaacaacaacaccgataattcggcagttaccattgatttctatcattgggtactgggggttcagaggcttgagatatttattgccagcatcttcaatgtagcgtttgaatgtcgcctcattaccatcggttagtttggcgataactaatttacctgaggtgggttcaacatctgggttgactaatatagacataccttcaggaatggttaagcccacaggagaggtcattgaatcccctttaacatcaagccaaaaggcattatgtccagcatacttagtggtggttacccactcgtctatttcatcaagactataaggctcaatggcttctgaccaatttcccgcgctaacccaactgattttgggatactcataggattgtaatgggtgcgagtctttattttcttttacattcgcatcccaattagcgctggatgtggattgtaattcaggatttccctttcccgtctgaagccattctggattgcataaaagagcacgggcaatattaaagagcgtattgccattaaagttttttgtcagccctaactcagctttacttatagctactctagacacgcctgatttccttgccaattcttcctgactaagattcaacgctgaccttctttcgctgaccctttcagctaaagtacttgccattgattcctctgaattatatccagctaaaaattgacaccaaagtaacactatctttggaaactttgttttcgttatgctcttgcctgaatctgatactttggttacgattagtgaggaggtatccatgaaattgtatgatattttgaaaactgaaattggaagcaatgcggaaattggccgccgatttcctgcaaaaggtaagtcacgaaccgggcaggcagtgggtaagtggcgatctcaaggagtgcccgaagatattgctctgttgtgtcatttatcttctaacatcccatacatctacaacccggccgactatggccgcaacccggaaaatcttagcctggttctgaccaaaccagctcatcagtaaagatagaggactgaccaatgaccacaatttatcaacctgccgctataacggcaggggctgcgatagcatctgacgttcggcgggagttgctatcccgcaaaaaggtgggaaagaacggtttaccgttccataccgtgcgtgaagatcagattaagacccgatggacagaaagcgaggcagtggccataaaaagtaccgccaacgcgctggaatccaaccccgcagtagaaaccaatgtagccgccattcgtggatttttggcgatgtttgccgaagctcccgacatgctggttcatgttcatgccgaattaaaactcgccggactgccggtacctgagtggctgcctgagcttcccatcagacaggagaaatcccaatgactaacatcacgcctacaaccacacaatcggtagaactcattgccaatattgtgggtaaaaaactggctattgacgggcaggaggcccgccgtatggctatcacaggggctttgtctggggtgactcaggcgttttattcccgtcaacatagtccctctgatactaagcagccgtagggggatctatgagcttgttatttaaatatcggccactggtgatcaatccagagttagcggcccgtatcggtctgaatgaagccattattttgcagcagatcaattattggctaacagaaactaactcaggcattgaacaggaaggccttcagtgggtttacaacacacataaagagtgggtaaagcagttcccgttttggtccattgatacagtaaaacgcacacttttgtcattggaaaaatcgggatgcgtccgtgttgagcagttagcaaaagcgcaacgtgacatgacgaattattacacgattcactatgagtgtgacgcactaaacagtgacagcaaattgccacagtccaagggggcagattgccctgatggagatagcaacttgcccccatccattagtgcagattgcccccatcagaagggggcaaattgccctgatgttcatacagagattacagagagtacaacagagactacttcagagaagcgcaagcgtaaggcggttaaaagttcgttatttgatttttcgtctttcccaatggcggtgagtcctgagatttgggatgactacctaatacaccgaaaagcaaaacgagcgccgatgacgcagaccgtggtgaacatgctgggtaaggagttgaacaaagcggctggggctgggtggtcggtggatgattcgttagcggaagctatggctgccggttggcaggggttcaaatttgaatggttacaaaatcggagtcggccacagagtcagtacgcgggtaacaccggcctgagtcgtcaggaagcactggaggcccgcaatgcacaggttgctgacgattttgtcaggtgtggggggtgatccatgcgggaagcagagactgaaaaacgagaatttgctgagatcatgaaagctattttggcgatctacggcaaagacggatccaaggctgtactaaaaatttattggaatgctttactgccatacgacattgaaactgtgcgtcaagcgttcagcaactgggtgatagatccagaacaaggccggttttcacctaagcccgccgatattatccgcaatatccaaaatattgacggtaaaccagattggctctcagcgaatgaggcgtgggcattggcattacccgcgcaagatgaagctaacaccgtggtttggacgaatgaaattgcccaggcatggagtattgcccagccaatcatgcaggagggcgacaaaattggcgcacgtatggcttttatcgctgcttatgaacgattggctaaggcagcgcaagggacaggccgatcaccgtcatggtcagtgtctgaaggatgggacaaagagacagtaaaacgtaccgttgagcaggccgtaacaacaggattgcttcccagacctaaagccgaaaagtatcagttgttgttgccagaaaaggggaaggctgggaatgaagtacccacaaaaatacgacaatttttagacgaactgaaggggagaattaagcaggatcaggaggcgcgagaaagcacatggcgtgatgaaagtattaggctacaagcgtctctggaacacaaataccaagagtcattgcagcagaccgccgaccacggtttgcaaaataataaaattaccgaggactgaccaatgagcattaatttcaagaatgtattgatttacaaattatctcgcgatgtttctttcgctgatttggaagagcaaatggcgcagttcgcattcacaccgtgcggcagtcaggatatggcgaaaaccggttggatatcgccaatgggtaacgaaagcgcaacgcttgcgcatgtggctaacaagcaaatccttatcacattgcagtgtgaaaaaaaggatttacccgccccggttatcgctcgtgagttggcgagtaaagttgagcgtttggagcaagagcaacatcgtaaactgaaaaaaacagaaaaagactcgctgaaagatgaagttatccagactctattgcctcgggcctttagcaaatactctacaacatccatctggattaacgcaggggccgggttaattatcattgatgctgccagcgcgcggaaagctgaaaatgcgttggcattgctgcgcaaaaccatgggttctctgcctgtggtccctttgacactggagaccccgattgaactgacgttaaccgagtggttgcgctctggcgctgcgcctgcgggattcatcttacaggaagaagccgagcttaaagccgttttggagcagggcggcattctgcgcagtaaacatcaggatttagtcagtgacgagatccgtgggcatatcgccgccggtaagctggtgaccaagttggcattggagtggcaggggcgcattagctttatgctgtccgacgatggcagcctgaagagagtgaaatacagcaccacgctgctggagcggaacgacgatatcgaccgcgaggattacgcgcagcgttttgatgccgattttattttgatggcgggtgaactggccgcactgattgcccatctagtggatgcgctgggcggcgaggcaaccagcagttcatgggtagatttggatggagtagaacgggacgatgatgatcgctatccagaagcagtgaacttcaccaaggcgaaaggaaaagcctcaatttcggggctacagcgtgaactccgtattggctataaccgtgccgcatggctgattgaaagaatgcaggctgaaggcattgtgtcccaacccgcaccagacgggacccgcgaagtgcttgctggggagggcgcgtaatggtgatcaaaccacacgtacccaatgccgaaagggttggtatcaataacgcagtaagatccatgcaattagctggccgtataagtgatgcaaacagccagttaaaccgcgtgatcaccgccgcaagtggtgctgattggcggacactgcgcgaactcgaaaagttgatgtctcagatgttccccggtgaaggtgatacccaggccgctataagtgctcgtctgcgtgaaattaatcctgtccgccatgggttggttaaacaggtcaaaattgtccgtaacgatgatagcggcaagcgggtttggttttatcgtctggttcctaccacgcaaggaggcatgcaatgagttaccagatttttatcggtgattgcatagactcaatgcgcaaaatgccagatcagtccgttcatagctgcattaccagcccgccatattatgggctacgtgattatggtgttgaagggcagattggtttagaggaaagccctgcggcgtttattcaacggcttgtcgcggtgtttcgtgaggttcgccgcgttcttcgtgatgatggcactttatgggtaaacatgggggatagttgggacaaagggaagcaattgaatggtatgccatggcgttttgcctttgcgttacaaaatgacggttggatccttcgccaagacattatctggcacaaatccaatcctatgccagaaagcgtgcgtgaccgctgtaccaaagcccacgaatatatatttttgctgagtaagtcgaaaagctattacttcgatcatgaggcaattagagaaccatctgtctacagcggtaaaaataccggcgtcggctttgggcatggcatggataagagtgacagaaatcgcggcaggatatctgcccgcgataacttcaagcgggaagacagtaagcgagcggtagttatacctgggcaaaatgtgggtacccatcgtgctgatcgtaaagatactgtctctgatggtatgcgggcaaagcgcaacgtttggactgtggccactcgtggttacaaagaagctcatttcgctactttcccgccagcactaattgaaccttgtgttttggctggttgtccgactggtggcgtgattttggacccattcggtggtagtggcacgactgctggcgtcgctatcggcagtggtcgtaaagctattctttgcgaattgaacccagcatacgctgaactggttccagctcgtatcgaaagtattttatctgcgtatccaattaataaggggtgtgcagcatgattgatttctccaatacccaatatgttcatgatctggccgctctcaagtccgccccaacacataagttgaaattaattggcgaccagtggcgcacgccagatgctttgttttggggtatcaatgcgatgtttggcccgttagttctggatctgttcagtgattgcgagaatgcgaaaacacccgcttattacactgcggaagataactcgctcactcaagactgggctacgaaactgaccgagttgaatggcgctgcatttgctaaccctccctacagcacggcgaaaaagcatgaagggcaatatatcactggcatgcggcacatcatggcttatacctccgaaatgcggcagcgcggcggtcgctatgtctatttgaccaaagcggcaacgtcagaggtgtggtggcctgaagaagcagaccatattgcattcattcgcggcagaattggctttgaagtaccggcttggttccgtcccgaagataacactcaagttgcctgcaatgcgggttttggtgcggctattgccattttcgataaggaatggcgtggccctgcgattagctatatcacccgtgagcaattacttgccactggtgaggcatttttagcgcagatccgcagagaggctgagcgcctgataccacaaaaccagccgaaaaatattccagtaccggaaactggcaacaccgtctggccggtcgaagtaaatctgtatttcagcaaaatatcgggtgccgctgaattacccgccgacctgcaacataaaatcttaggcaatatcaaccgtatgaaattagacggtattccgtctgatgccatcattgccgccgccacaacactcaccgccgctatgggagcaacatcatgaaagagatcatcgtagataattttgctggtggcggtggggcttctaccgggatcgaaatggcaaccgggcgcagtgttgatatcgccatcaatcatgatccgaatgctatcgccatgcacaccaccaatcaccccgacaccctgcattattgtgagtcagtattcgatattgaccccgtggccgcgaccgccggcagacctgtcggacttgcatggttcagccctgattgccgccatttcagtaaggcgaagggcagtaagccagttaaaaaagagatccgtggtttagcgtggatactgattcgttgggggttagcgaaaaagcctcgagtagtgatgctggaaaatgtggaagagtttaaaacgtggggaccgctactgactgccgaagatggcacagaacaccccgatcccgcccgcgcgggtgagacattcgccgcatttgtagcgatgctgactacgggtattgatgccgaacatccagcgttacaggagtgctgcgaggttttagggattgatatcaatagtatagatgctaaacgactgcaggctggtttgggatacgtcgttgatcacaaagaacttcgggccagtgattatggtgcgccaaccatcagaaagcgcttctttatggtaatgcgttgtgatggtttgccagtagtgtggccggagccgactcacggcgatccaaaattattggaagttcagagcggacaccgtaaaccgtggcgcaccgccgccgagtgtattgattggtcaattccttgcccgagtattttcgatcgcaagaaaccgctagcggagaacaccctcaaacgcattgcgcggggcattcaacgtttcgttatggataaccccacgccgtttatcgtgaagtgtaaccacaccagcagtaaaactacatatgactgtttccgggggcagccattaattgatccgttgcaggccattaccaaaacgcctggcttctcattggtcactccaatcatagcccgtatcggtcaaaccggttttggtggcgatcgtatggcgtatgaagtgggtaaaccactaacgacaatcactagtaaggctgaacaccttcttgtcgccccgatcattgctcgtgagtttggtaatagtgtggggcatgtggttgatgatccaagcggtactattacagcgggtggaggtggcaagtctcggcttgtttctgcattcctggctaaacacttcggcggcaactataccggctcaggcgctgatctgaatcagccagcccacacagtgacaacggttgatcatcatgcgttggtgacttctaacctgataaagctgcgcggcacttgcaaagacggtcagcaggttacccagccaatgccaacaatcactgccggtggtctgcatatcggtgaggttcgtgctttcttactcaagtattacggcaatgagaaagagggtgttagcctgaatggccccctgcacacagtgaccaccaatgaccggttcggtctggtgacggtcgagggcattgattatcagattgtggatatcggtatgcgtatgttgcagccgcatgagctttacgccgcgcagggtttcccgaactggtacatcatcgaccgcgattacaccggtactaaatacgccaaagataagcaggtagcccgctgtggtaatgcggtgccaccgccatttgcggaagcgctggttcgggccaatctgccagaaatgtgtgtagatcgcgatgaggtggcggcatgacaacagcaccgcgaactaagtccccgagaaagaaaaagactgaagtattgggcgtgctgttacctgggggtggaatcaagtacgccactgaccatgatcgggaaactatgaagggggtgcctgcgggcactccaatttcaatgagcccaattggtgaccggcgcaacctgaagcatcaccgtaagttctggaaactgctcgagctggggttctcttattgggtaccggattggacctttgttagcgcacctgaagagtggatagctcacgaggtagctaaagctgtgggcagcgctgcaggagatccggaactctatgagaaggtgacaaagtctatcgctcaggcggtgctagacagagtaatcaggcagcgccagaaaaggtttgatggagaggcggtaaagacggactccgcttatttcaaccacgtcatgatcaaagccggattctatgacctgatgcccaacccagagggcggcacattgaagcagcgctggagtattgcgttcgtgaatatggatcagggcgtttttgaccgaatttataaaggggtggccggtgttatctggaatgagacattaggccagcactttgatgacgagtatgagatggaacaggcagttaaccggttgctggagtattgatatgaaatcttcggcatttagaagcaaagccctgcgcgattctgcgcggggccaatgctgcacgctccagatacccggcatctgtaacagcaatccagaaacaacggtattgtgccatttacccagttcaacccacggcatggggtataagtcagatgactactgggccgtatttgggtgtaactgctgccatgatgttattgatggccgggtgccttataactggcagcccggagagcttgaggaaacgatattattggcattacatttaacttttaaatattttttctgttgtggcctcatccaactgattgaaaaatgatgtgtgtcattgaacgaacttaaaataattgataagagttactttatatttaaaccaatttggtggaatgcatggaagatcaaagcacctttagaatcaagtttgcctattttcattcaacatggaaaaggacgatacactcaattccagttttaaagtctcaggggcgaagagttctacctagtgaatttaccctagagatggatcaagctattttctgcccagaatgctttacaccactgactagaaggccgaaacataaggatacgacaacaaatggtcgaaacgccagttttgctcatctacgttcttttcgtgatgtaccttgttttttgcgttctaaaccagctgaagggaaaagatatttaaacgaagaagaagctaaaaaagcgatttcagatgatcaattgacaattgtgaaagcatttatgacagatcgccctgaaataaaaaagtctgaaatcggaatttacgatcaaaactatttagaagatatcgatggtggtttgtcggaagttgctattggcaggcatacaggtgagtctttttctttgccaaatgtaataactacagtcgcaggtttttgtcggaattttgacaataattactataagttctttgttttacctggtgaaaaaaatgcggaacgtcttgacagattgttggttgatataaaagtgattaaagatattactgattcaccaaggctatattttggaaaaatattaagtagttggagtaaaaaacctttggatcactcaatacggatgactcgattgaattggccaagaaatgacaattactctgatttttattttaagcaagaaaataaagatgctcaagataaagggatccgaactgatagccagggacgctacattattatgtatgggatagttgaaaagagtgggactggtttgtgtttggcaggtttgggttggggcgaatttgctctccttccagaaaaatataactatctattagacgataaactgacgaaaatttgataaataaaattgatgccattgaccttgttcgaacaaaagccaagctggaagtacgaaatggaacggttcacaaggttaaccaccaggcagaaaccgaagaacaggcagcgctgattgagtgggcagataaaaccgttatcgatggtatttgtatcggggattatctgatccatatacccaatgaagggaaacgtggaccaaaggcggcgagggatgccaagcggctaggtttgaggaaaggcgtaccagatttgtttctggcgctgccgcgcggtgggtatgcggggttgtggatagagatgaagagtagcaagggacatgtaaataataatcagaattgttggttatcgaaacttggcgacataggttacaaagtagatgtctcctacagtttcttaagtgctaaaggtgctattatttcttacttagtaaatggcaaataccttgggggttaaatgaaaaactatagtagtttcttaatagatccagataacaaaggatgggtgctcggatacggagttttccgcaattcaccgtggcactttgttgaaacatttaatactgagcaagaagctttagaaaaaagagccgagtatgactctgattataaagttgcttatggttctcatcgtgttggtagtgatgatttcgtacatgatgggaatacaaagtgatttcattttttgcaataatttaattattattgcgatttgtgaaatgaactataaaatcagtcctgtgaatttaaaacacaggactgaccaatatgaccactgcaattgaacaacttattaaaatgcacgatccgcgctgcgtcagcattgaatcgctgaatattggccggggtcgtgccgttctgaccaaagaccagatattagggactttcgccacctgccagcaccaacatcccattggcttcgatatcttgatgaccaaataccgtaatgactgccaagccgagcagcgcttacgggcggttataggtgggtggttgcataagcgaccacatccagcgcgagctattgctgcctgccagttggcacttaatatggtattggatagaaaccttccggcgcaggtagagcaaattgccactttactgcgtcgttacggctcccgtacaggtatcaccagaaaagtcgttgatggactccagcagcaaatcaaattactggaaagagataaagcgcaggcacttgatgatggcactatcgcattactggcagacgaaataaaaacccttcagtctaaaatcaaaacagaacgtggtgcactgcgggcgtgggctaatcatcaggcggcgataaagcaagtctgcccccgttgtcacggtgccggtaaaaccctgcggcctcatcccgaaatatgcaacgagtgcggcggcagtggccgtataccgcctacaatggaacacctgcgcaaatctatgggtatcataggggctgagatatccggtggggattgggcggcgcaatatgtgcctctggttaaagaatgtatgcattggctatatgttgaagaatcgagtgctggtgaggttttaattgaaagaattcagctagaaaaagacttttgaccaatgattgaccctacatcattaacgcgctaaattacacaaagatgccggagtatgcttaaaagctgctccggttttttattggtcagttccggtcagtcctgactacacccaaagcctgcatggttcgcccagcaggcttttttatttccccaagccggggaggtggagcatgaaaatggagaggctcacaaccggtatctcttataccgcgagcggtggcggcgcactgttttggtttaaacaattactgaatggatttgcccctgagcaatgggcggctattggtgtgctgggtagcttgatgtttgctttcctaacattcctaaccaacctatatttcaaggtgcgcgaagataagcggaaagcggcgaagggggaataatggcaatgtcccccgcgttgcgcaagaaagtcatgggtgcggcaatcggcggtgcaatggcaatagcaatcgccatggtgggcggcagcgatggtctggaagggcgcgaatataccccttatcgtgatgtggttggcgtgctaacggtatgcgatggtcataccggcaaagatattattcccagcaaacgttatagcgatgctgaatgtgatgctttgctacaccaagatctgatccccgtatttgccaccattgaccgcatcgttaacgttccaatgcctgatttccgcaaagccgcattggcatcatttggctacaacgttggtattactgcaatgacccattcaaccatggtgaaaaagctcaaccgtggcgacacttctggcgcgtgcgatgagctccgcagatggattaaggcaggtggcaaggtctggaaggggttagtgaatcgccgtgaagtcgagcgcgaattatgcctgatgccataaaccccttataaattagccagtaatacccatttttaagctgctttggtaacgctacgtgaaatctgaattgctggtgtctgccattacccctacttttttcatagtaaacggctttaagcccggatcctgatatgtccacaaaattcattatcgcaattgtggtcctgtgcctcggcggtaccgcactctattttcatcaatctgctgcggagaaaggcaggcaattattgcaactgcaatctgatctggatgaatcgaaagccactctggcattacaggctttccagttccagcgctcaaatgagatagcggcgcaagccggtagttataatgtcaccatttctggcaaaagcgaggaaaggcaaattgaaaaccgcaaagacctcaaagttgaggaatgcgctaatcagtacatccctgattctactgctcagcggatgtacgactatacgaaccgtttacgtgccagggcaatgcgcaattccggccagcctgacggaaccgctgctggtaccacttccccccgcagaatgacataccgccaagccgtgttgtggattgacccgttgctgaccctgttagaccaagctaataacgatagagaatcgatccgcagtctgccatcacaacaacaaagcaaacaggagtgagtcatgcattcaccaattatcaaatattttgcatatacccatttaccaccagtgcttcaggaagtcagtaagccaattggtgatttagctattgcaatggatgagcagttgcccgatagcgcagagaaagcggctggcctgcgtaagttattagaggccaaggattgtcttgtgcgcgccaaattaggttaacaaatcacttcaacaggaaattactatgaatttcggacaagcacttcaagcactgaaagctggatacaaggtggcccgcattgggtggaatggcaaagggatgtttctaattcttatctcaggcactaaagatgtagaaccttgcgagggaacaccatacgcagatttagccgtttctccccaaggtattgtgactatcaacgcccacattgacatgaaaacagctactggtgaaatgcaaccaggctggctggcatcccaaacggatatgttagcagaggactggaccatcgtaggtaatgagacagtggtcaactccgttggtgagtatgaattgcctattgggcaaatcgtgaaagtcgatggtttcccatttgagttacgggaaccggtaagggcgctaagtagccagcatgtactggatgttctccgtgctgataagaacatagggattcaggctgtttaagtcattacagagtcacttcctgtaacgaacggtgcaatagtgatccacacccaacgcctgaaatcagatccagggggtaatctgctctcctgattcaggagagtttatggtcacttttgagacagttatggaaattaaaatcctgcacaagcagggaatgagtagccgggcgattgccagagaactggggatctcccgcaataccgttaaacgttatttgcaggcaaaatctgagccgccaaaatatacgccgcgacctgctgttgcttcactcctggatgaataccgggattatattcgtcaacgcatcgccgatgctcatccttacaaaatcccggcaacggtaatcgctcgcgagatcagagaccagggatatcgtggcggaatgaccattctcagggcattcattcgttctctctcggttcctcaggagcaggagcctgccgttcggttcgaaactgaacccggacgacagatgcaggttgactggggcactatgcgtaatggtcgctcaccgcttcacgtgttcgttgctgttctcggatacagccgaatgctgtacatcgaattcactgacaatatgcgttatgacacgctggagacctgccatcgtaatgcgttccgcttctttggtggtgtgccgcgcgaagtgttgtatgacaatatgaaaactgtggttctgcaacgtgacgcatatcagaccggtcagcaccggttccatccttcgctgtggcagttcggcaaggagatgggcttctctccccgactgtgtcgccccttcagggcacagactaaaggtaaggtggaacggatggtgcagtacacccgtaacagtttttacatcccactaatgactcgcctgcgcccgatggggatcactgtcgatgttgaaacagccaaccgccacggtctgcgctggctgcacgatgtcgctaaccaacgaaagcatgaaacaatccaggcccgtccctgcgatcgctggctcgaagagcagcagtccatgctggcactgcctccggagaaaaaagagtatgacgtgcatcttgatgaaaatctggtgaacttcgacaaacaccccctgcatcatccactctccatctacgactcattctgcagaggagtggcgtgatgatggaactgcaacatcaacgactgatggcgctcgccgggcagttgcaactggaaagccttataagcgcagcgcctgcgctgtcacaacaggcagtagaccaggaatggagttatatggacttcctggagcatctgcttcatgaagaaaaactggcacgtcatcaacgtaaacaggcgatgtatacccgaatggcagccttcccggcggtgaaaacgttcgaagagtatgacttcacattcgccaccggagcaccgcagaagcaactccagtcgttacgctcactcagcttcatagaacgtaatgaaaatatcgtattactggggccatcaggtgtggggaaaacccatctggcaatagcgatgggctatgaagcagtccgtgcaggtatcaaagttcgcttcacaacagcagcagatctgttacttcagttatctacggcacaacgtcagggccgttataaaacgacgcttcagcgtggagtaatggccccccgcctgctcatcattgatgaaataggctatctgccgttcagtcaggaagaagcaaagctgttcttccaggtcatcgctaaacgttacgaaaagagcgcaatgatcctgacatccaatctgccgttcgggcagtgggatcaaacgttcgccggtgatgcagcactgacctcagcgatgctggaccgtatcttacaccactcacatgtcgttcaaatcaaaggagaaagctatcgactcagacagaaacgaaaggccggggttatagcagaagctaatcctgagtaaaacggtggatcaatattgggccgttggtggagatataagtggatcacttttcatccgtcgttgacaacttcccaagaggtggctcaataatggcccacaacagaccaatagaacactatggcaaagcatgattgggaagcgttacaaactgcatttctggcggacaacgcggatacagggattaccgctcagcaatggtgtgaacagcatgggcttaattaccaatcagcacgccgctatatcaaacctcgtgctgcgcagtctgcgcaaaagaaaccccgtagaactgcgcacaatgcgcaatcagatactactgcgcaacagtgcgcaaacagtgatgaaggggaagaggaggaacaggaattatcatcggacgcagacgatgacagcgatccggactctgagccccccgagaaaccgaactccggaaggtctggagacgggcgattcagcaagggtaatcgtcattcagaaggtaattcaggtaatcccaatcccgttggtgccttcactcccggaaaccaaacggcaagaaagcacggtgcttatgctcgatatcttgatgcagatgacttgtttgaggctgcagcagattccgatcttcatgacgaactgatattcactcgagcgcgtgcgttgtctgttactaaaaccatgcggaaaatccacgaggatctcgtggcggcgggatcagttgaagcgcgtatcgaactgtatgacaagctgctaaaggcggaatctgctctggatagaaatattggtcgcattgaatcaatagagaatagtttgagtaaattaaggctggatgccatcaatgggcctcgtttaacggctgatatgtatcgtatcaaagcagccacttctaagctgaaggcggaaacccaaaaattaacttcggaaggaaaaggggtcacaacaccactcagtgaagcggtgaaggaagttagagattcagggcaggatggtttgctgtgacacaagataataggcttaacgatacagacattgtagcaatgggggaggcagaacagatcgcctatatcaaagcacacttatctgatgtttggtggcggttgaataacttgtacaagatcgtcaatgaagatggtgagctggtaaccttccgtatgcgtcccgcgcagcgggaattgttcaaaaatatgcactatcgaaatatcattctaaaagcccgtcaattaggcttctcaacgggcatagatatttaccttctggatcaagcgctgtttaacaacaatctctcttgcgggatcatcgcccaggacttaccagcggcaggggaaatatttagcaccaaaatatctattccttttgataacttgcctgtttggttacgcgccacctttcctgtgagcactcgacgtgaaggagcaaatggtgggcatattgagtttgcccacggttccaagatacgtgtatcaacctcatttcgttcggggacagttcaacggttacatatttcagagcatggaaagatttgcgctacgtatccagctaaagcgaaagaggttagaacgggtacgctaaacgccattaaagacggctgtattgtttttattgaaagcaccgctgaaggtgttggtggcgatttccataccatgagcacgcgagcaatggatttaggccaattaaatctaccgctcacatcacaagattataaattccatttctttgcctggtggcaggatcctaagtatcaggctcctgtacccgctggcggcctgcgtttaagtaaataccatcaggagtattttgctgctgttgagcaagcgatgggtatcactttgcttgatgaacaaaagcagtggtatatccgcaaagaaattgagcagcaggaggaaatgaaacaggaattccccagcacgccgtctgaggcatttctaacatctggccgccgtgtattcgccgccattaatgttatgaaggccgaaggtcagtgtaagtccccgttgctggtatatgacattgagccagtcaccggtaaacgaaccaaagttcaggcattacgtgctggcaatgcagaagaacttcaacgcactttactgaatcacttattagtgtgggaactgccggaccctgatgaagattacgccattggcggtgatgtggctgaagggctggaaaaccgtgaccgatcatcatttgatgtggtgaaaaagtctagcggtgaacaggtcgctcactggttcggctatcttgatgctgagctattcgctcaactgatggcccatgttggccgttggtacaacacggccttcattggtcctgaacggaacaaccacggccacgcagtcatacaaaaattacgcgaagtttacccacaccgatctatctattcagagcaatatctcgaccgtgaccacgatgatgaaacgccaaaactgggctggttaactaccgcacaaagcaagccggtcattattgaggggcttaaaacattgcttcgagagaacgcctccggtgttcgctggattggcaccatcaacgaattgaacacctacgtttatgacacgcggggccgtatgaatgcccaaacgggttgcttcgatgaccaggtgatgagctatgcaattgcacaagaaatgagagcacgtatgccagcacgtccaaaacacacacctattgaccgctcgaaacctaaacactggatggctatctgatgaataccgctactaatcaaactgagtctgctcagccagtaaaccgtgaccgtttcacacttgagcgcttgatggatatttcttcagatattgaccatcagccagactggcgcaccagtgctaatactgcttgtgcttattatgacggggatcagcttgcaccagaagtggtagcaaagctgcgagaacgcggacaacccttgacgcaacataaccttatcgcaccaacgattgacggcgtgttgggcatggaagccaagacacgtactgatttaatggtgattgctgatgatcccaatgaagaaatggaagtcatggccgaggccgttaatgctgagtttgctgatgcttgccggttaagtggcttgaataaggcccgcagtgatgcttatgccgagcaaatcaaagccgggttatcgtgggtggaggtgcgtcgtaatgatgatccgtttgccaataaattcaaagtctctaccgttcatcgtaatgaagtttattgggattggttcagccgcgaggcggatctaagtgattgccgttggctgatgcgtaagcgctggctggatgtggacgaggttaaagggactttcccggataaagcacaaataatcgattattcactcaacgagtggaagggctttgttgatactagcttagcggagggacaagagtctgatttgatcagtgcgtacgaagagtatcaatcatggagccgtgagagtaccgagtgggtcacatcaaaccgtaaacgcgtattattgcaggttatctattatcgaacatttcagcgcctgcccatcctgcaactgagtaatggtcgagtggtggaatacgacaagaataacgtgatgcatgcagtagcagtggccactggtcgggtgcagataaccatggcgcgagtcagccggatccgcgaatcgtggtttgttggccctcactttatcattgaccgcccctgtaccgcgccgcaaggcatgtttccgctgatcccattctggggctatcgcaaagataagaccggagcgccctatggtttggcctgccgtgctattccggcacaggatgaagtcaatttccgtcgcatcaaactgacttggctattgcaggccaagcgagtgattaaggatgcggatgcgacaaacatgaccgataaacagttggccgaagagatcgaacgcccagatggggtcattaatctcaaccccaaccgcgccaataaaaccaccgccgcagacgcattaaatatccagcaggacttccaagtcgcccagcagcagtttcaggtgatgcaggagtcaatgaagctgatccaagatgggcttggggtttactctgcattcctcgggcaagattccaacgcggccagtggagtagccatcagcaatctggtcgagcagggggcgaccactctggcggagatcaacgataactatcagttcgcttgccagcaggtcggccagttattactgtgctatttgctggaggaattaacaaagcgcaggaattatccagtggtaatcaatcgtgatgaccctcgtaagcgcaaagaggtggtgttgaatgccgaagaagaagtgggtggtatgaataatgacatatcacgcctgcgagcgcatatcgcactggcaccgattcaacagacaccggcctataaatcacaactggcgcaacgattgtctgaagttattgtcgggttaccgccgcagattcaagtcagcgtgcttgatatgtgggtagaactgctagacctgccgaacaaacagcagtttattgagcggatccgtggggcgctggggacaccgaaatctccggatgaaatgacacccgaagaacagcaagccgcacagcaggagcaacagctacagcagcaacaacaagaactcgccatgcgcgaaattgctggtaaggttgcaaaattggaagccgaagcacaacgcattaatgcccaagcggaacatgaggccacattggccaatggtcagcgcttcaatgatgcttatactcaggctaaaacgggccaagtgctgcaagacatgcagaatgtaaccgaggagataggcgctttacgtgatgaaatgatgagtactattcagggacaaattaatcaattgccactctagctattgcaagcatgcagaataagcgctaaatttccgaaagatgcactacattgcaccgaattaagcctcgcctaaacgcggggctttttgctttctggcgtctctgattttcatctgaataacttgcccacaacgcgtgggcttttctttttctaccaattcggtttatgccgctaagcgctcttacccaagagtgtttattcgcatgggcagcgatacgccttcctcattcggatctatccggtaaatagtcatgcaggagttataacgtggacattgaattaacaggtaatgaaacgccagaagagttggaagcgctaatcgatggatttggtgatgtggatatttctgatgtaacacagacagcagcggttacgactacgcccgttactgttgttactaacgatgcaagtgcagcagtagtaaatacgggcgataagaaagacgagctgacgccgggcgcgacgactacagcacaagtcactgaagtgccgatcactaaaacgacagccaccacgcaagcggcaaccactgaaggttctgagaaaccgaaaggcattctcagcaaagatggtcagcacgttattccttacgacgtgctggtggccgagcgggcagaaaaacagcgtttggcagggtccaatcagcaagctgcaactgagttagctgatacaaagcgccagcttgaggcgttgacccgacaaatcaacttcgctggtatgcaacctgctccattacctgagaaggctcaggttacacctgaacaaatcgatgccatacgcgatagtttccccgagatggcggcagtgctggacacgatggtgcagaaaatcgattacctgcagcagagtcagccagcaccggtcacgaacggcaacccagtaatggatgccatgaatgctgtacctgacctgaagtcatggcaggaccaagatcctgaccgtttcacactggcagtacacattgatactaatctgcaaaatgaccctgcatggaaagataagtctttaactgagcgctttgtggaagtcgcgaaacgcaccaaggccgcctacggtgaatcggctcaacaagagcaggttacgacaaccaccgccacgacgaccaactcagatgttcaacggattgccgctgagaaattggctgctgcaactgcggcgacgcaagtacctagctcaccgtcagatcttggggtaacaacaattcatacggcctcacctttggagcaagctgctaatgcttcgcctgatcagctacaggccatgtttgccggtatgacggatgcccaaattgaggcgctgttagaccaggcaatctaataaccctactgatttaaatctcaacccgctacggcgggtttttcatttatggagtatctatgacgactatcacctctgcccaggcgaataagctaatgcaggtcgcgctgttcacggctgcaaaccgtaaccgctcatttgttaacgtactaaccgaacaacaggaagcgccgaagtcagtcaatcctgataaaaaagggactacccagacaagccacaacgcgcccgtggtgcgtatcactgatctgcaaaagcagaaaggcgatgaagtggatatgcaaatcgttcacaaactgtcgaagcgcccgacgatgggcgatgagaagttggccggtcgcggtgaaaatctggcgtttgcagactttgctttgaagattaaccaaggccgccatttagttgatgcgggcggcaagatgtctgagcagcgtttcaagcacaacctgaataagaccgcccgcacgttgctgggaacttacttcaacgatgtgcaggaccagtctgccaccttccatctggcgggggcgcgtggcgattacatggccgatgacaccatcgtgccactggctgaacacggtgaatttggcaaaatcatgatcaatgatgtattgccacccacctatgaccgccatttctattctggtgatgcgacatctatggaaacattggatgcagcggatctgttcacgctagccactgtcgataacattgccttgttccttgatgaaatggcccatcctttacagccgatccggatgtctaaagatgagttggctaatgaggatccgtattttgttctatacgtgacgccgcggcagtggaatgactggtacacatctacttcaggtaaagactggcaagcgatgatgacccgtgcagtgcaacgttctaagggcttcgatcatccgctgttcaaaggcgaatgtgcgatgtggcgtaacgtgctggtgcggaaatatggtggtacgccagttcgttttaatactggctctaaagtgttggtatcaaataatgacttggtggcttcaaccaagctaatcaccactggcaccaccattgaccgcgctatgctgctgggtggtcaggcactggctaacgcttacggtaccggtgatggcggtggtttctttggctataacgaagagaaagtggatcacggtaatgggacagaagtctctatccgctggattaacggtttgaagaagatccgcttcaaacagaaagatggccgagtcaatgaccacggtgtcatggtagtggactcagcggtcactctgggcaagtaatctctcagtaattcaatacgctaatacctcaaagggcaggcttcggtctgctctctttttgtctggagaaaaatattatgacaatcattaaagcgccttctattggcgacgcggtataccaaggtccgcaaggcaatctgtcgctggcagaagggcagattattttaaaagatgcggcagtcggtgatgtgattgagtttttagaactgccgatcggtatgcgtatttatggtgtgagtgttgtgagtgacgcgcttggtgcgggtgtaacagtagagattaagagcggcaccacctcattagtgtctgccgcgagtcatgctgttactgtcgcgaagaacgtgcccattactccttacagcactatttcagcaggcgagaaagtgactgcggttattgcgggtggccctgccagtggtcatcttgccgtcaacattttgtatgtggcagtaggttactaatcccaccaatccctctagaaacccgcctcggtgggttttttcctgtctgctatttggagtattccatgcctaacaaaatcgccgtggtctatatcggcccaaaagaaaaaaaacgtgacaccattaccggtagccgcctggtattcccgcgccacaaaccggttgaggttgaaagtgctatcgcccatcaattgttggatttcccaactgtatttatccgacacgatgagttggaaagtacgcttaatctgcaacaaacatcggaacaagagcatgcagaacttgcggtacgcctcgcagcgctggccgtactagaggctgcgaagaatagttttgtcctgacgattggcggtgatgatgtcgatattgccaaactgacgtctattcaactggcaacgttagtcgaatcggaagatctggatatcaagcagggcgctcaggaaaaggtagatgaattccgcgcgcgtgttcgtgaagctattcaggccaagaacgccgccagtaccggagcagaataaccatggcaacacttgacgcatttctgccgaccattcgcaagcatattagcgggccgctggatattatgatgaagcaggccgcactagaggcagcgatcaccttttgtcgtgagtcgttgctgtgtcgtgatacggttacttttcatgatgttactccgggtataacttatatactgacggatagcgagctggtgaaatgcgtcaagcgtttacgggtattagatctcactaatcaggtcagtaatgccagtgcgccgggtgtcatgttgacggcgggcattgagtttaccgtaaagtctgccaatcaaatcaccttcaatcagccactgaccaaagtcaccgtagattttgctattgaacccaagcgtgatgttactgaagtgcctgacgttctggccgacgattacgcagacgtaatcgccattggcgctctggaagatttatttattatgccgggcaagccgtggacagatccgcagcgctcacaatacttcggggcgcgttttattgatggttaccgccgggcattccgtgaagcgctagataactccccgatcacagccttcaataaccctgttcgccaacacgagttcttctaatgatcaccattgccgagattattgggcgggttaacacccagctcaaagatactgcatggttgcgctggccgctggcggagctatgtgattattacaatgatgccgtccgggcagtcattcttgcacggccagatgctggggcaacgaccgaagtgattaccgctgcgattgggactaaacaaacgttgccggatggcgttatccgcttaattgagatgattcgcttagtagacggcagggcattaaggccggtaccgcgtgatgtacttgatagccaatatcctgattggcatcagatgacgggttctgttgagcgttacacctataacgaattgacacccaaagtgtattacctgtttcccggccccgcagagccagtcgatattgatgctgtagtggccagaattccgatggccgttgctatcaatgacctggcagataaaacaccagtaccgattgacgagctttatgtgaatccgttggtggattggatgctgtttcgttcgtttagtaaagatggtgaagcgggggcaaacctcaatttagccatgcagcactatcaagcatttagcgatcagttgggggttaagcaaaattctgagagtttcgcccagcaattgaaagaagcgcagtaccagggaggtgggcagtgagcgtaacagtttccggcattatgattaacccggtcggcgagccagtagtcaatgcacagatcaccctcacagcggttaccaatagccttactgtgctcaatgccttttcggccacagtcagaacggacggggtgggtacatatcgcatccagttagaagagggcagctactccattacagtggctgcgaatggccgtagttttgtttatggcgcggtcacgctggataacaccacaggccccagcacactcaatcaattgctgaagcagcagatcatggagtcggaactcacacctgatgtgatcctgtacttccgccagattcaacagcaggtcgcaaatgatcttgcaacaataaaagttttagaaatcagtgctacagatgcggcagagagcgcaggtcattcacgcgatgaggctatgttgtatgcaaaggatttgtctgaggcgcttgcaacagccaaggggtatcgcgaccaagcgggcataagtgcggatgcatctgcactctctcagcaggaagcggcgataagtgaaacgagtgctaaagccagtgccgattcagcattactgtcagagcaaaatgcgctttcatatcgcgactcagcccagtcagcagcggccacagcagccgatgatgcgtcaacacttgcagccgagcggacagcagaaaaaattaagttacaagttaaaactgatgcggatcgtgccgaagcggcacgtatagcaagtgaacagataaaatcctcggtagatgacacagctcagacagttgctcaacagcatggcgaaacaacacaagcagctatcgccgcacgagatagtgaagtcaaggcaacaaccgcggcaaacagtgctgttcaatcggaagcgttagcggcaatcagtgcggaaacagcacgacagaacgcaggaatatctacagtagataaaaatgcagcaaaaggttttagagatgaggctgagggttttgctcagcaggcgcatgcttcagcagaaagcgtcggcgatgtaatgccaaaaactggtggtgcgttcacaggcccagtagagttggcaggtgatgccacagagccattagagcctgtcacatttcaacagtttgaaaggaccggtggcgaatttctattaagtgtgaagtggcatatgagccgaaattatattcctgcgggctgggccccagcggacggtcaattactatcacgcaatctatttccattcgctttagctgaaatattaagcgcgaaatatccgatcgttgcggatgactcgtggttattttacaaagaccagcgatctagtttttcggtcggtgacggaagtacaacattcagaattccggatttgaacggcaagtcccatgacagcatgggaagagtgtttttggggggggacggtaagaactccctcggagaaatggggagaatccaaggcgacgcgagtagaagaattactgggacgttcggtggaattggcgggcaacttaatgtttcgtatggtctggttataggtgagactgccggagcttttacaagaactggcgtggcaactggaaggccggttccatcaaatattggggagcccgcgctaggtgagcttggtgttagttttgactctgcattagtaaaccccactgcaatcgaaaatcgccccatcaacgccacgggctgctacataataaaattggcagggtcggctctcaatgaagggcaaattaacgcgctcgaattagcaacgcagataacacaacttgcatcgcgcactacaactttagaggctgacgcgtttactgctaataaaatagcaaatacgccatggattccgctaacacttcaaaacggctggttaccccttcagggttatcacaatgcaatctatcggaaaataaatggagtcgtatacgttgaaggagttatcaccgcaggtgcatggggagaaagcgtggttattgcaaatctacccgctggatataggccatcagctgatcaagtgagtgtcatgccaatttcaggtagcacgcagggtggcattacagcgcaatcgagaattgcgttgtggacggatggggcgttaagaatttatggagtaacaggaaacggagatattggaataaagtcacactgggtgatttaacgagaatattatgaaaaaactaaataaattagatagtgatggcttctatattgaagattatatcgagggatatttacccaagaattggacagatgatttagtcggtgacggttactacaaagctcagtatcaaaatgcgactgtaaatccagaaacaggagaatggacatgtgggcagtgggtagagactagcggaccttcagctacagacattgcagctcagaaagcggaatttgttgctcaagcgaaactcaaaaaatcaaagctgataagtgatgcaagcgatagaatagagattctaaaagaccggattgaggcggggcaagatagagcagcagagttgaaattatggaagtcatatcgtatagcgcttgatgatattgatgtgagtacagcgccggatatcatgtggcccgtttctcccgacaacataaaattgccggtggttttaaccaaagcaaaactgggcaattaagcccagcctatttcagtcatacaaccagcgaccagccttggcggactcaataagcatccctatagtgaaatctggaacaggtatgggcgctgtttttttgaatggattccatgagaaaggttcatctggataatagattttaatattaaacttatcttttgggatattgaatgttgaaaaaaaatcattcatgagttcctcagcttcttcttcctccatacgaagatcagtatcaaggtccgtttctggcgttaatactggctgcttactcttaaacagataagcgccatcatggcgcctaacaagttcataaatacactgttcaatactatttaccatattttgtcgttacccctggctatagtgttgtaatcacgtattgctctataagtgatttctgatacgtcagcagcaataatgatgaggccaagcaggggaatagaacgacctacaaatgttccaatattagagaccatcctccgctttgctgtccaaggtgtatacccacctatccatgtaggtaattgaataccaaaggggaattgtgatttcttaaatacgcctcttgctgctttggaggcatatgaagtgcccttcattgcacttataggcttaggtcgagtgggaagattatttctacctgacaagatcgcggctgcagcaccaaaatcagccatgcctaaaccaaattgatctacagttttttcaaaaaaaatcataaatagcaatccgctggcggttaaatttgaacgacctgcataaaagtacgtcccgcccagctcttcaactgtatccatagtacatccttgttatcgtgttaattattgcttaaagcccatttgctcttcatcagcatatattgttacctcacatgattaaactagagtggcaagagattcagacaatcctcaaatgtatttaatttctcattacgttgatatcagagaattaacgcgctaaattacccaaagatgccaagcctcactttttagtggggctttttttatgcccgccggaaatcactcactatgtctgctatcgatatcacaacaatgcgcggcgaaatgccacgggcggttgcacatctattgcctgagcaagcggcgaccattgctaaaaactgccattttcgccatggcgttattacaccgctaatggctgatgaagacggcgggaaaactttcactatgccgccaaccacaattttccgttaccgcgatgattattggtttgcctggactgacattgtcgatgcgatacgcagcccaatagcacaggataaatatgagcgggtttatttcactgatggaaaatatcccaaggtcaccagcaatgaaatcgctacacaagggaacggtaatttccctgcggtcagttttcgccttgggatccccgcacccagtaatcctattgaggttactgcgattacaccgccggctgatcatggtgaagatgatccaaccgatgatgatacccgtttttatgttgaaacttatgtcactggctatggggaggaagggccaccggggccagtatcgcaggaagtcacaatcgtttatcccggcagtaccgttgatcttgctctacagccaccgggcagtcagaactcaaatatcacccgccgccgtatttatcgctctgcctctggcggtggggttgctgattatctgctgttggtggagctggatattggcgtgcttgtgtatcaggacacttcgcttgataaagaacttggcccggtattggaaactgaaaacttcctgatgccgccagatgaaatgattggtctgtgtctgatggcaaatggcattgccgcaggttttgccggtaatgaggtgatgttttctgaggcgttcctgccctatgcatggcccgatagctacaaacaaagtaccgaacacgatattgtcgctattgcgcctattggtgccgggctggtggttggtactaaagggcgtccctatctcttcagtggcatcaccccgtcgaatattaccaacgctaagttaccggtgatgcaagcctgtgtcagccgccgcagcatggtgagcttggacagtttcgcactctacgcgtcacccaatggattggtctcggtcgatggtgctggcaatgcattagttgcaactgagcagattatcgagccgcgtcagtggcgtaaaaacttcaatccagaaagcatcaaagcgtggcaggtcgaaggtgaatatctggcgatttaccagacggcaaaaggaactaatgccggatttattttcgatccgcaagcgatggatattcgccatctaaccactgtttttgatactgcatttaatgatctggagtcggatacgctctacaccattaaaggcgataaattaaccatctcccaagccagtgcaacacctttgccgataacgtggcgcagcaaaccatttcttgcgccacctggtacatcattttcttgcctgcggatcatgagtgagagcgtgagccgtgtaggcgtcaattttattgtggatggttctccggtgctgtcgttgccgccggggtcattaattgatggccttctgaagttgccgccaatcactggccgccggtggattattgaagtatggggttacgcacaagttgatcgcatcaccctgagtacctcaatgacggagatgccagcatgacaaacggctttcgtgctggccgtgattcagccgcactctctgaaaatattgaggtattgactggccaacgcggtgacggtcgcaatcgtgctgtgacttatgctgatttggctgatctggatttagccaaattgcgcaccggcgctggcggtaaattacagctcaaacccagctccaatgataatacggggccagccccatcttttcccactcaaccacaaaacttcaaagccaacggcggttttggtgcggtactgcttgagtgggctatgccgaactatcgcgggcattcactgaccgaaatctaccgcagcaccgaagataatttggcgaatgcggtgatggtggccagctcggctgcggcggtctatggcgacccggttgatccgggctggcagggttattactggattcgttttatcaactccgcaggtgtggctgggccatttaatgccagtgaaggcactccggcaaaaacggctgcagatattgatgaaatcattgacctgattaataaggagataaataactcgccgttaattggtgaactggcgagcggtattgaggatcttgaccaacacggtgggcaagcatttcaaaaaatgtggagcaccaaagttgatgccagcgggatcactgcaggtatcgggattgtcgcaggcatcgatgctaacggaaaacccattgctcaggtcgccatatcggccagccagctttttgtctttgacccgaacaatcctactgataccggttcttatgctattccgttttctatttccgacgggcgagtggtcattgatgaggcggctatccgtgaagccacaatcaaaattctgaatgctcaaaccattatcgctgatgaagttaaagcagggattagtatttcaacgcccacgctcaatagcgccacgatcaataacggtaaattcaccgtggatgccgccggtaatctgaagattggcgaactgttcagcgtttcaaataccggacgaattacaatcaagcaaggtactggcagcatcggccttgttatcactaacgagagaatagaggtttatgatgagaaaggtgcgcttatggttcgtcttggtaagcttaattagtttaacggcatgtatatcggttggtaaaaacccgcctcctgattttaatttcaacggagtttggcagtgtcgagctacggtctagaagtatttcgccgcgacgggacgtctatcattttagataaccaaacgtctgtgactaaaatactgacgatggggagcagagagtcaggggtgggttcgtggaataccggtgtaaccattccagagggttttgattattttatatggatgtcgtcatatgcgtggcttgaatatgttgttgcggtcaatggcggaaaaagccaatggactccagccaggcatgcttataatcaaccctcactggatgcaaatagagtattaaaagttaattcggtaaattataacacgattattccgggttcgtattttggcgtatatacatggcctacaggtgtggaccaaggcaattatggcatacaattctttggcgcgaataatattgcaggtattacggatgctagccaattcacttgcctgttattcaaaggggaagtggatatttacaatggctggttacccagtaatatcaatgcggaattcaccccagacaaggtcatatgtttcttttacaccgaggatgaaagcaagacgatttgtgcaaaatcagcccgttactataatagtccgtctgctgtaagagattatagtgtttacagtgtgggcggtggtgaatcatcaacacccattcgtgcgaaagtgtgcattttcggtaacgggcaattacagaaagaaaactacggtctggaaatctattctgcggtggataaatcattagtctacaactcaggctatgacattcttgctcgaccaaagcttattcgtctggccggaatggcactgggagaaaaaaagagtgtggagggcattcctcggccaatgtacgcaatttgtaatattggcggattgttcactaataactggcaagtgaatgtctggataaacagcaatggtactcagataggcccggcttggggtcgggctatttatgagccagcttcgtttggtccttatacttatttcactgcggatattcagatcatggtgctggatgctacagactactttcacttctaaactggcacgaatagctggtgatgctggggatcccaaactactcattcacatccaagacgcctgccgtaaaaagcaggcgttttgcttttcggcggaagatgcactgatcgtcttacggccacggatgaaggaaggcattccctatgtggtggtatgggtcggggtcagcaccgggcagcaaggcttgattaaatataccccggaggttcagcaactgactcgcatgataggcgggcgctgggcggagttttatacggcacgcaaagggtttatccgaatcgctaaacgcctcggcttcgagcgtatgccggataaagatggactgatgaaattcaaaataccggtatgaggtcattatgggtaaaggtggaagcggtagcaccgagattaaagaaacatcgcaggaaatagctgcggcggagattgctgggaaacagtggcaactgtatcaaaatgaactcaaaccgatggagaatctattcatcagcaaagtagatgcaatgaataacgagtcgaattatgacgatgcggcgggtaccgtcaacttgggctatcagcaggaatttggtaaggctagacagcagacggcaacagggttagccgcatcgggcgtcgatccatcaagtggcaaattccagagtgcacttggtgatattcagagtgatcaggttgccggacaaatagatacaactaatcgggcgcaaacctcgcagcaagataaatatgtagccggattacaggatgtggtggcgatgggggccggacaaaaagctgatgctctgtctggttacagcaatattgctaatcaaagtttgagtaaggcaacaagtgacgctcaaaactctctcagtgatcggcaagccgtggggcagttggtcggagcggttggcggtgttgccgcgcggagttatgggcttaaagacgcaagcagtaaatccacaggtatctttggtggcagctaatgacaggaggtagttatgggacaggcatctgatacttatgccaaccttattcgtgatcagtatgatgattggcttactcgtttttatccgaagcaaaaagagcttatgggcttggcgaccagcggcgagctgatgaaccaacaactaacccgtgtcagcgacagttcggcgaatagcctccaatccgctcaattgggtacgcaaaaccagttggctcgttatggcacaactcaaacagcaaaccctgatgataatagtttaggtctgcgttcagcgctggcgactgctggggcgaagaatggtattcgcgaggctgagcaagatcgacaaatgaatattttaactggcggcagcgcaagcttgcgtgagcaaatgagtattggcggaggaggcaactaatggggtacggactgatcgatgtcgcacgtgatacccgccaacaagcgttacaggggctaggagacgcatcaagccgtgagattcaacgtgagtcatcaaatcaacagcttaagatgcaacagcagcagggtaaaatgagcatgattggggttggtgcgggtacgggtatggcgatgggtgggccgctcggggcaggaataggggcggccgtaggtttgctggcgggcagtattttctaaaggaattatcatgggcgtacaaggtttagcggacggttttcttgctggcttcaatactgcggatcaggcggtaagtcgcaatcgtgaattgggtttacgtgatgcagcgcagcagcagcagattaaagattctgagcgtaattatggcttagctaaagatcaggtggactggcggaaagaaactgatgaccgggatcacaagtataaagcgcagcgcgatagcgcaagtgatgagcagtggaataaaaactatggtctggcgcaggcaaatcagcgtacagcaaatgcgagccttggtctccgcgccgaagaaatcaatatgcgaaagaatgagtttaattaccagcggtcacaagccgagcgccagcagcgaatgcaagaagaaatgcccgttgttcagacgctgtataaacaaattgaaacgacggggcaggttgatcctgagctgttcgggcaaatttcaaaggataatccacttaacccatcccgtttttttgggcaggaagccatcaacaatgtaatggaaattaaccagattatgccgaaagtgctttctggagaggtgagctacaacgaccctaaagttttgaaggcgatgaataccgtactggcccctcacatccaacgcaatattgatgaagtcgatccggagtctggcaagaagattaagagtaaggaattgggtcacattggtatcagtgaagatggtaagtttgttattcccggcctgaaagtcacttatagcgatggctcgaccgccaataaacctatgacccagttcggttctgctgatgtgagtgataaccaggtagcgaaaatccctatcgatcagtttatgaatcagatacgtggctacggacagatggttgggcaactcaatcagcccgatcgagccaagtttattggcagcatggttaacccgccggataaagctgcgatgcgtcaggagagtgaaggctaccgcaaggagttactggatataggcaaagacgaaggcaaacaattggctgcgctgaataaagatggtgcaatgatggatgaaaaacaattatcttcggcaaggcaggaaattaaaaacaactctgagcaacgccgtcagcaagcctcggaactctatggtgttggtgggggacgtagttcacaaaatcaaccaggcattgaccctgcagagttggaagcatttgtgggtgaatatcaaaaagaatttggtgaagcgccggacctgagtagtccacaagatcagcaattctttatagcgtggaagcagaagcaactacagcaaatgaaagaacactcaccgagtgcacaacctggtacaactcaaagtaattcagctcttgatagcaatacagcgcagcagctaaggggactgaagcgcattaatggatccataccacgataacgctgacaggcacccacgaatcaataagtaggctatgtcattaataaaaattatattttataaggataatattaatgaaaatgaatactgaagatacattagagtgccttactgccttgttggatctattaacacatagtgatgaaaatacctctattgaaacaatcaaaaacgcgtcccttcttggactaattttagtttctgagctgaagtctaaaaagacaaataacccttaacttcacattaaactaattacgcgctaaattacccaaagatgccaagcctcactttttagtggggctttttttatgcctaaaatttggagtctgttaaatgacttacgatccgcaacaacaacgcccggaagggcaggttagcaatagcaatcgtgaaactttaaatattcgccagccaggtgagagcgccaatactggtttcgactggggggccgttagggcagcacgcgaggcggcaggacgatctgcgaaatctcaagatccgagcgtgggtataaaggatgttctcctctctattgctgcggctcctgctgatattattagcggtaatgcacaattatttaaggcaggtaatcagtttcttgatgatagagcatcaaagtacctacgcggtgaaaagaagccactgattgatattcctattagccctgaaatgttgaaggtgatgcagaataatagtggtaacacattatccaacttgggtaatgccttgattcagggggctgggactttggccgaaaatgcttctaaaagcattaaggataactacagtgatggggcaaagcaggccgctgctatgccatttattgaacggaataaggatggtaaccttcaggctggtgcgggattattcgataaagatgcgtggctgattaacgccattccgacaataacacaaatggcaacgagtggtttggttgcaaaatttggtgccagagcagttgcggagggagttgagcgggcgacttacgaaagacttaaaaagtcagtaccagatgctgttgcaagagagactgcgcaactggcgggggagaaggccagaggtattgcacaaaaaaccggctttgttggtattatgacggggaccgctcaaggcgctagcggcaatgaaatgcgtgatgagataaatgcattaccctttgaacaattaatgcaaagtcccacttttcaaaaagcgtttgcagttattgatagtgatccaaacaatgcaaatatatcagatacgcaaaagttaactcttgcgcgaagttatgtggctgaacaagcagcgagtactgtgaccgccgaccctcgattattagcggtaaatatcgctgcatccacattgggtgaccacacattactgactttgctgactaagacaggggcggcttcaggtgtgctatcgggcgtagctagaggcgcagttgcggaggggagtaccgaatttgtccaaggcactactcagcgataccttcagaatcagcagctcatcaatacggcaggccagaaaattgaccctatgaaagacgttatggagtatggggccaataatgccgttctgggtatcggtattggtggcgcgatgggtggcgcgggtggtgtgcgcagcagaaggtcagtctcagaagcaccacccgacaatgccggtggttcgccgacatcagagaaccctcaaccaggaggctcaccacaggtagataatccggctgcacaacaaaactcagtcagtgaaaatggtgtgccaacatctcaggttgatgagttccgtgatacgcccgcttacttgcgtcaggatcctcgcgtgcagggcttcgctgaggatagtgatgcacaacgttcgcttgcggatctggcaccacaaccaaccgcccaagagcttattcagcaacaaatggagtcgggtgatcagggttttacacccgatgagttagccattctacagcaagctgaccaacttcgatcacagcgaataccacgcctgcctgcgccgggtgatatccatctgggtgacggtttcccaatgccgggaccagtacgggggcctgtggttgatgaggcccaggctggatacgtgccacaatttaccgctggagagcagactcgtggacaaatctatttaccaagggagacgcaagctgagcagcagggagggggcagggagacgcatacatatgatggagaaaccgaaccgcaaggtataacagataagaatattatcttttctgatggggctgcagctaatcctgatcatgtgcaggctggtacgcctccgcagtttgatggggggcagcgtaaagacgtgcgccgatttacggagcagatgggggggcagcctgccccgactctcactgatcagcgccatcgggttggcggtattcctattgattcccagactgaggcatatgcgaaaggtgagaaccctggtcagttaaaactgtttgccaaagataaaccgttccctaatgagaaagtggctaaattttccaagtggggaaaaatgccgggggctgttattgagccagtcggtgatggttttggtgtgcggctaccgccggatccggtcaacagaaatacaaaaccagcgccctcaactgagggcgttgttgtatctggcgataaggccgatggtgaattaaaactctatgcgaaggaccgcccgttcgccaacgagaaagtggccagatattccaaatggggaaaaatgccgggagccacaattgaacctgtgggtaagggctttggtgtccgtttgccagcaaagaagtccgcacctcaggcaaagagtcctgatatgaaaatagaggattttggtgagaagctacaaggggcggctaaacatcggtggggccagttggctgaagctttacaggctgatcaggatattgaagatattaaacggcagcctctttctaaactgttccctccccctgattatgcaaaaatggaaagtggcgttgaaatagataaattggcagtagtcacagcgctgcgttcttctattcctactaggcctggctcaccttataagctcaatcagtgggctgaacaagttaaagctgtacgcgacctgacaaattcaattatcaacaacaatgtaagcgttgccgatatcaaagctcgtttccgcaacaagcccgcattacgttctgctgctgatgcaatagatttaatctcacaattcaagccagagcaaatggcttatgcagccaagtacgggatccgttccggtcattacacctattttggtggtaagagctatcccaatgggcaaaccatgtatgaacttgttgcccctaaaggtgtgaaggctgatatttcagccgcatcaatggctgagttattacctaatgcgaaggctttcattgagtctcaactcgatagtggtagcggtaaaccagcgcctaggcaggcaaaactggaaatttttactcgacgggcagataagggcgtattcattggttacaaaggttcgataggggtattgcctcttaagtctggttttaaaacgccaactgaggcacgggcttatttggcagaaaaccgtgtagaaattgaagctaagctggacaagttgcgcaaggtatcgcgggaagagcagcgcaaattaacaaatgagcctcggacggggatcgatcgccgtaatggcaatgtgacacctgagcagtttagtgatgcctttggtttccgtggagtgcagtttggcaactatgttgaggggccacgccgccagtctgacttaaacgatgcatatgactcgctgattgatatggccgaattactcaatgtaccgcctaaagcgatgtcattaaatggtgagctgggcttggcatttggcgctaggggcaaaggcggggcaaaagcccactacgagccgggacaagtggttatcaatctaacaaaagggaatggcgcaggctcacttgcacatgagtggttccatgcattggataactattttggtaccactgatgttcacggcgaggcatccggcaagcgctcaggggcattcgttactgatcgcaagcgcccacgctatgagtttagtgaaggaaaaaggagtgagattactcaccccgtgcgtcaggaagtgcatgatgcttttatgcaagtagtcaatgtggtcaacaatagtgacatgatgaagcgtgcgaccgttttggatgcaagcaggagcaagccatactggacaactaaactcgaaatgtcagcgcgtgcatttgaacgctatttacttgataaggcagaaaagagtgggatcagtaatgattatatggctaatctgcgaaaagccgacgaacatgccaaccctgaaacttacgcctatcccactgaagctgaattaagtggcggtgttcgccaggcatttgagcatctatttaacaccctcaaaaccaagccaactgataaaggtatcgccttctattcccgcaagaataccaatatcgagcaaggtaatgtcatttccgatacaggtcatactgtcacaggcaataaacctgcaaagggaatgcgccaacgtgaagcacaagttatatctgatatgtgggttcgtggtatgagtggggccgcaaaaatcaaagttaaggtggttcaaacccaagctgaagcagcggccatgatgcctagtgggatcccgaaggaatttggtacggtccacgctatttatcagcctgaactcagccgggtgatcgttgttgcggataacattattgatggtcgtcagcttcgggcaaaattgcgtcatgaggtcttggcacaccacggcctcgcttccgttattggtgatgtggaatatgatcgtatcatgcgcgtattgcatcagacccgtgacagcaaaaataagattattcaggatgtctggcaggaagttgataagtcataccggaatgagtccccagaaatgcaggctaatgagtttttagcccacatggcagaacgttcagaacttagtagcctcagtggggtatgggatcgctttgtttctttactcattaatggattgaaaaaagcgggcatgatcaaacctggggatatatctcctacggaaattcgtaacattttgcgcacagtggcgggtcggtttaaaaaaacggctatgtatgatggcgaacaaccgggaacgcgggagtttgataatacgttttcacgctctgatgccctgtattccaaaggtgagaagtcggatccacttcagccaacccgcgaagatgctgaacagtatcggtctgagttaaccagtgcaatcaaatcacttcgcagcgtggatacacctatccgtgtaggccgaacgcctccggtgttcagagccttgggtgctccagatctggatatggtgatcaatcgagatactgtgcgcaaagccaccaacggtgtaaagcacaatgtacctatgtcagttatcgaacaattgcctgaactattacatgacccagttgctgtatatcgttcgtcaacacaagaggattcagtggttgcgcttttggaagctaaagataccaatggcgatcccgttattacagccattcacttgaatgcgcgaaagggcagaattgaggtcaatagtattgcttcagtttatggcatcgagggggggagaaagattcagacaatggaaaatgaagggttgatactctatcgacggaaaaaacaaaaccccgagagttaccagtccagagggctccaattgcccaaggagggtaacgaacgaggttcgagtaaaaatatactccactctgatgatatccgcaacaatgatgcgttctactcccgcaccgccaacccagtaatggatgctgaaaccaacagaaaaatgggctttaacgttgagcaggggtggttcaataaagccaaagccttttatgacacggtaaccagccaagataagacagaacttaaggcatggctgaaagaaacaggccgcaaattgaataccaaaacattcgatggcatggctccgctgaagtatgccgaggatgcagccggtattaatgatgcgcggagttcggcttatatcggtgcgcgtatggctgccggtgccggttctgtcactgcagcaacattggagcatggcttgccgcgttacaacaaagctgaggggatgattgagcgtcaggcgggtacagataagagtgactcgctcatggggatcttggatggactcggcaaccatcgagagagcttcttaaaatggatcgcgggtcaccgctctgaacggttgatgaaagagggcaaagaaaacaactttaccgccgatgaagttgcatacatgcaaacccttaacaagggtaatgaggcattatttgatgctcagaagaagaaatacgatgcttttattaaatcgattcttgacctccagcaggatatgggactcatcgagccggcaagccgggcgcaatgggaagatgcctggtatctgccttattaccgcgaagctgaaaatggtgaggtaagcgggccatggagcagtaaaggtattgccaaccaaagcagcacagtgcggaaacttaaaggcagtgatctgaccattaaagatcctatagaaaacctgtttaactacgttgccaagtcggttgatgcgtcaatgaagaatgaagctatgcgccgtgcggtagttaatctggcagatactggtgtacttgaagttattgactcaccgaataagatggattttgagcgcataggtaaaagacgtggtgaaaatgtttgtcgatgggcaagaaaagttggttcaagttaatgatccgcaactttaccgcgcattcaccatgattgaccttgagcgcagcagttccgcatttatgaaagcggcccgcacagctaaaaaagtgctgaccattagcactacatcaatgcctgattttattatccgtaacttcttacgtgattccgtgcactcctgggctatcaataaagatggctttaagccagttaccgcatcgtttgctgggtttaaaaaaacactgagaaccgatgatacttttgtcgatatgatgtttgctggcgcaacatttggcggggggtattcaaacgtctacgatccggcgtctacggcacaaactatccgcgctgtgctgcgtcggaagggttataaagacagccagatcaatcagtttgaatcatctattgcccggtctggcaaagaggttttgggcaaaattgagcagggattgcagaagtataagcatgtcagtgaagcggcagaaaacgcgaataggctggccacttatgaagctgcagtcaagtcggggaaaagtaaagctctagcagcctttgaatctcgtgatctcatggacttcagcatgatgggggccagcaatatcatgattaatttgagtgatatgttgccgttcttcaatgcccgcatgcaagggttaagtaagttaggtcgaggtattaaagagaacccccgtgaggtactaaaacgcggaggcatgattgctgcagcctcactggctctgttggcactgaactgggatgatgaacgctacgaagaattacaggattgggataaagacacgtactggcatgcatggattggtgatcagcatattcgtattccgaaacctttcgagataggtctgatgtttggcactttgcctgagcggtttgttcgtgcactggggggcagagatacaggggctaaatttggcaagctggtagcacataactttatggaaaccatggccttcaacccgattccgcaagtcgccatgccgattgctgaagcttatgttaactatgatttcttcaaaggcagcccgattgagaatatggcagataagaatctgatagctggcgctcgttacaacgaccaaaccagcctgctgatgcgtgaaattggtcaagcgacaaacctgtcaccgaagatgcttgatcacattattaccgggtacaccagtagcctgggcgggtacgtgcttggagcaaccaatcttcttatgcgtaatctgaaggactacggtgaaacacccgctattcgccttgatgaaatgcccgttattaaatccttcttccgtgggactgacccagccaaatctacacagttcactgaagatttctaccgcatgatgacccaagccaatcaaattaacagtaccattaacagctttcgtaagcaggggcgtggtgaagatgccaatgaattgttagaaaataaccgcgggaaattatcgcaacgtaaggggctaacggcgactcagcaacaagtgaagacactgaatgcccagattgaaatgatgaggcgggaccggatattaacggcggatcagaaaagagaaaagattgaccgattaatggcaaccagaaacaaactggtacagcaggcagtggagagggtgaatccctattttaataaataatataggtgggctagagcccacctatgttcacttgaaaatatttttaataatactgttaacatgagcttttgcgagttttaatccttcttcttttgcgactgccatgacgctctcgaagtcattttgttcgccgcaggcaatacattctattaagtcaccagattgaaattttgcatcaccagggcctttcagctcagatttacagaataagcaatgcagtgagacttttccgagctctgttatcgacatactaatctccttttaggatttttactgcaatggttgttgtggctattataatggttattaacccaatgatacctttgtgttcttcaatactatccgatattttttttaaaacagttcgtgattttttcttttgctctaaatttctacgagagcggataattcccaccccggaagtagtgatccccaaataggagtacttatcatttaacccacggtgcttgagccattcatttgcaatacacttatcaactgatttctgaagctctggcaaagtaaaactttgtttataccattcattgagttcatcacagagttgctggtccaagtcaaatatgaccgcctctttaatcagcccattcctttccatgtaatcgatgaaatactgcagtaaataatattctttcataataatgcttggtccacgctaataatataaataatatggcattgtgactaaaaatagtcaaaatccatactgtttttaatgacattattgacgcagtagacattgaatattcattttacccattcgtggatcatgactaagagggtaagaaacataataaatccaatgatcccaaaaataatactagcattactgtccatatgcatattgcatttaccggccaacaggtaagcagcaacgacaaagggaatgcagagagcggggtggatggtgatcatcacggcagcgagaattaggcatactgtaaatagagttgaagtcatattgtcctcattatgatgttcgaaaattccccgagcatttccgacgctcttgctaactatatattgatctttaaaaaacggtatttaacttgcaccaagggtcttttaatcccttgttttttcttcgccttatcctttgaactgattttttaaaatattgatatatgtcatgtaattaaatgcttggtttggtgaaaaaatcatttagccaattgaaattaaaggatattatcggcgctttaaaatccctcggcttatggctgtgcgggttcaagtcccgccccgggcaccatggaaaatattctaagtaaaacaaagtagtacgagtatgtcgttaaccgccgagaggcggtttttttgtttctgggaaagcggaaaaactggaaagtggcgacagaatggcggcaccttggcgacgaagattttttgagcaagatagttttagtgagttctaggcgaaaaaaaacccgcaaaagcgggatgagcgtcgggtaaataaatttatttccagccgtcagaacatgaccacctggccgccggtttgtgggtggggcatcaccggttaatctcgccgggcttcgatatagaacgcataaaactttccatcgttacgaatgtatggccacaattcacattggtgcactggtgatagcgctctttggtttcggtggttacctggctactgctgcgggtgtgtgctgcctgatggcataaagggcaattgaacatgatagcgagtccgttatcatcccgactgtggtcggtattaatgataattatgcgttattattgattaaaaatcatcattccatatccaaatcatctattttcacctctaattccagcgcggtagtaaaaccgctgtcactcacggaatgggtcaccgtgaccagcgtccaatctgcttcatcaatctgttttttgaatccagtaactttaaccggcacctcgggatagagatccgcacgccctttcgccagttgaatagagaatttcgccgcgccccgttgcagccgttcccagtttgattttgccgcccgctgtgcattgtttttactggcgtaagtggtgcgtaagatcagcacattctcatcagtaccgatcagatattcgccctgtttctcttcgggctctttgggcttggcggcagtggtcgccttacgtttgcgttttcgcttgaccttaaccactggcttttcggtggtgcgagtattcagccagttggcgacaacgccggtataagcgccccggtcagccatactaaactgatggccgtcgcccagactgcgaataatagtcatggccgggatcggtttaccgctggcggttttcgactggccctgacggataaataacagattgccatttttcacagcggcaatagcaccgtattgtttcgccagtcgggtaataaaattaccgtctgattcgttggtttggtctatatggtcaatggtcaaatcagacatggttttatttaatgttggggcgagtttattccgctcggcaacggttttaattatcccgccaatagtggtcttatggtaagactgatcccggcgaatattgagcgtttcacgaaaatccgcactgcgagcgcgaacagtcagcttatccggcgcgccactgtgttctatttcatctacggtaaatgtacctttatcgatcagcgccgcgcctttccagccgagtgataccgctattttagcgccacggcgcggtaactccactttaccgtccgcgtcatcaaactcaatatctaattgatcggcttcaaagccccggttatcagttaacgtcaatgacattaggcgctttttaatgccacccgttttatctatgccatccacggaaatagaataatcgggttcgttatgcccggtatcaatgcttatcatgataataatccggcggcggtgttcgatacgctgctggcgatatcgtcaaattgctgagacagctccccaaacatctcttttagtgattcatcggtacgttttaagctaagcgtaaattcaattttacgggctgacccatcactgaaaaaaatacttttagtgcgttccaggctctcaatgacaaacatgccatggatcgcgccgttcccttcaatcagtgaccaggccttgccggtttctgccatcagttgcaaggccattaatgaaagcttgccgccggtcagctctggatacaacacaccggataaggtaatggattcttcatctggccctaaaaattgactggatgagcggagaccaaaacgggcatttgacggatgccgccacgccatctgatgttgaaaatcttgataaggggtggtttgccgcataaagacaaacatccccagtgccatcatcatgttattgctccttagtcgtcatggtcttgataactgcggtttgatttgctctgttccctgcggttgtgggcggccagctggcgggccacctcgcgggcaatatcctgcgcatcctgctgtggcgtcgggtaaatattgataactggcgcagcatggctggtttgattttgctgatgattatttgtctgaccgttgctactgcggtactgtgccgccggtaaactgtaaggatggagcggcgcggcgctggccgggtagccactgaatagcatggaagccgcaaccgccatagcggcggtgttgcggcggctggtgacctgtgccgggccgttgatgatttccgggccatattcacctaccacgccaaattttccgagcgggatggtaccgccgttatcatatgccccggtatatttactttcgatataggtgcttttcgtttgcgctggtttccacgccacgccgtagttacccgggcccgcggcagtggctgggtttgcctgcgccagtgcctgggttttgtcagagcgttgctttacttcatccagtttttcaagtacccatttaatggatgagatcaacgcatttatcggtatcatggccagtccaatgccgtcagccaaaaactgaccaaaggccttaccggcattagcggcgcggtttaaatcggccgtggttgattgcaccggttccagtaactttttaaaccagttccacacgtttttgactgcatcaccaatccagtcaaacaccggccccagcggtttaagcgcctctttaatcggtgcggcggcctgcataaagccctctaccacccccccaaggaacgctttaatcggttgccagtacttgtaaatcaataagccagcacccacgattgccgcggcaattaacccaatcgggctgatcaggatacccaacatgctacccaggccaccgagcgcgaaacgcaggaacctaagcggggatttagccagccagctaataccattaccgagtaacgtaaagccactgacggccgatttcactggcgagcgggccacgttcaccagaccttgacccaacccttttaaactggcgatggctgagcggccgccctgttgagacatcacgagcagtgagcggctaaagttgccaatttgcgcacctgtaatgggcgtgatacttgccagtcgaaacagactcaacgacaagcgcggcaataagcggatccccagcactgaggtagtaaaacggagcagggcgaaggggcctaaaatacccacggcagcaatcgccagcgccccgaatgcggcggttgcaatggcgacaacggtacccacttttacaatcgcagtactcacgccgggatgagccttaaggaattcagccacgccgtgcataaattcactgatgccttttgccgccgaacgtagccagtcgttattcttctcaaataactcaacactgatattctccatggcggcatggagaatggtcatatcgccttttaggttgtcgagcatggttgaagctacgaggtttgattcaccatcatactggccgggctggcctcgcatctgctccaacgatccatcctcggcagcattcattaacacgccaaatccggtaacggcatattgtccggcaatgcttttatagattgcaccgcgctcaacattacccatttttgcggttttctcgttgatatctttaagaatatcaaccagatcacgcatattgccgtctttatcggcagttttgacgcccaaatctttcacggttttagagccaccaatacggctcaagatactgcgcatagtggtaccggcctgactgccttgaataccagcgctacccagcatagctgtggccgccgccacggtttccagactctggccgtattcgcgacccacaccggcagagtacttaagcgattcacccagcatcgggatatcgacgttattccgggtgaagagggctgttagcacatcggcaacgtgatccattttctccgctggaatacccatggcggtttgaatattggaagcaatatcggcagcagtagcaagatcaatccctccggcagcggcgaggttaagcataccgggcattgcccccataacctgtttcgggctatagccagtgcggccaagaaagtattggccttcagccacttccagaacggtaaacttggatgagagtggcagggtacgggcctggtgacgcatcgcctgcatatcctccgcgtttttatccggaatgcgggtaacggcctgggttttgctcatcatcgcgtcaaattcataacccacacccaacgttttggttatcccccgacccatggcgcggccggtagcaaacgaggtataccctaatccggcggctaccgctttgcgctgattgctggcatcaaagcgattgcgggcggcattcaggcgttgctgttgttgggcttgttgcgctaaccggcgttgttgtgcggccagcgcggcggtggtgctggtgatgctggctttaagggttcgctgtgcttgtcccagtcgattagtggcaacgccgctgctttgtaaggcggcacgctgggtgtggagtgcggtacgtaagtcattgtacttttgcttgagttttgcggcctcttcactggcacgcttaaactctctcgcctgcttagctgtaggcgctgcgctgttttttaattcagtggcgagttgacgcgctttatcgcgggcggcagtcaacgcctgtgcggcacgatcaacagcggctttattctgacgaaaaccctcaattttggccgcctggccattgagttgcttaagctggtctttcgtcgttttgatggatgcagccagcgttttattgctggccaacatagatttaaatggccgggtgattttatctatggcacttaaggaaacccgcaaacggaggttcttatcactcatcactgcccccgttgcggataatggctttatgtcgccactctaaaagttcacctaaggacatctcttcggtagcggagggcggccagtgaaaggttatcgcaatatccgctatcaaatcgtcaacggttaagctgtcaggaaatctgaccgcaccgagttcggtaagaaaaaaagcgccagtgcctgcgataacgcgtaaatatcggctggttccaaattgttgatttctggcacggtcaggttaggggtggtgacgcgaggcagcacacggatcaacgcatcaacatcggtatcaagcagtgcctgcaatttggcgccgcgcaatgcgccggtattgggtttattgaccgtgatctgcgtgattgttgtattacctcgcatgatcggcgcatctaatgtgactacgttaaaggcatcagcagaagtctcgacaggcacggacggtaatgcatctacagtggttatcttgctcataatggttaccaataaataaggggtaaaggcgcggagttatccgcaccgtgatattacaggccgatgttgcggcggtgggcttccagcatatcgacgccgctgaccatttcgaccatgttcacaatgtcgatctcgatcagcacttcgccatcccatgccaatttgtagtaagtacattttgtggagatttttgtggtgctgttatcgccttgtttgctgtcaccgccgtcgatttcttcgtggcgaccacggaggacaatttctaccgcgtgggtttcgccggtatcgtcgcgctgataggagccagcaaaacgcagtaacacaccatcgactttggtcacgccccattgcttgtagatctcggactcaataccgcccagcgtccagtcaacgtccagcgccccatcagccagccccaaatcgaccttggcgctgccattcatcccgcccccgcgaaagtcttcaaatttgcggtttaattttggcaaggtgatggattcaaccaccccctgatagctgttcccgtcattgaacacattgaggaacttaagcttgcgtggtaatgccatagttacgctccttagctgttaacggcggcggcgaaattagccagataacgatcagtaatgcgttggcgcagggttaaatcttccagcggcggcacaggcgtatagtcgtaatcaataaacaggcggccagcctttagtgtgtctttatcgtttacgctgtcgtcgtaccagcagtcaccatcaatcagataacccaatgatttcagctcgcgcattttggcgcgaataccctcaataatgtcttttgccagtgacggggtaagcggcttatcgttagcccacatatgggcctcggccatagtgtcagccagtacctgcgcggtgcgggtgtagttctcaaaggcaaacagcggatcatcggaacaggagcgggaaccccaaaaacggtagccatctttgcggatcagcgtggtgacatctttgctgttaagcaaattggcatcggtggcgctgttttgcagatcccagaacacatccgcactgataccggtgacgccattcaccccgacgttagacagcgttttatgccagccaacatcattatcaattttggcacgcaagccgagggcgcgagccgtggcgtaagcggtggtttcggcgttagtgaccgtgtcccaactgaggaaatcgggccaaatcaccatcgcttcgcgctgactgaagttatcgcggtagataatggcctcttctttggttttgcaaccgtaggcgctgatgtaggcaaaggcacgtaggctctgagcgatggaaagtagctcagtggataccgccagagtgtcatgaccgggaacccctaaaatacggggcttgacgtcaaacttaccctgcgccgctaacagcgctttcatgccggtataacggccatctggtgctattccgccaataatatttgacgtggtttcagcttcggtttcaccctgcgccacccggacaacgacggtcagtggtttggtttggtcgctgatagcatccagtgaatgggctaatgtgccggtttcaccggctttgccgctggcggccagcacatcggtgagtaataccggggtattgagtggaaacagggtggcgtcagcatcatcggaagtacagaccatcccgaccaccgccgtactgacagtgcggatcgggcgggtgccttcgctgatttcaatgacgcgcacaccgtggtggtaatcggttgcagacatgcggttttctccggttaagcgttcattcgctatgatgccggattactgtgcgcggggcaggtgatgaggattgtgtgaggggtggcacaacagagaaaccaacaaccccggctggcggggttgttgagcagggctatacgactggcggccagtcgggaacaatatagccctgattgaccgcttcaatcaaaagccattgcggcagttccggcaattcaacccgcggccagttttccaccgtgggccatgcgcgataggcggcgcgggtagcggttaactcggcacgttgagtatcagttagcgggctatcatcaattgaataatcaattacagtaattgaatccgtggttttaataaaagcatcgcgatgacggcgggcaagtgcggcgagggtatcgccgtgaggcgcaggtaacggcggaatatccagccagaccggacggcctttcataacccctaacattttccccgtggctggaacgtgtttccaatatttcgtttgttcttttttcgtgagcaatagtgcatcatcaggccagctacctgttgccagatattcttctttccattcctgcggataaaaaccgcccgttgtagcagaaaaatagatcatgttttttatccttaatagccaatggcgaaaataagtggatagcacaggttttgctgtgcagtgccaaaccattgcgggaacacctttaccgtgctgttattccaacgcgatgtttgaaacatcacatcggcttgtattgtgtcattcccctgagtggccgtgaatgccattagacacgcaacaggaaaggcggtggggaaagccagttcagggtaagcgatattttcgccggcagaaacagggccagtcatccattgcacaatcagcccgcccggcacgtctggaatacggatataatccgaaccagaaaagtgacgtttaccaaactgtgccagcacacccgcgattttattgttaataaatccccaaaggttcccacccccttccccccacaccgccccggtgatatttccactgccatccataaacccaccgtcaagccctcccgcacgcactatcccattagaaataaaatgacctcgggtagtgaaatcaacacccccagtaacaaagttgtaatttgtcgcgaacatccactgctccccaccttcgggatgcgtattgacataatctgtagtgattgatgtgaccgagtcacgaatataacagcggaacccggcggaataggcatcagaacccggcgaacgacattcaattttattacgagaagtaacaaccccgaccgcgtcaatattggtttctgatttgatattacctgcgctcagtgtgtcatgaacgtgtaatgatttatcaaatgtgcctccccgtgcacgtgatacgacatcattggctgacgcggcacccacatcagagaatgtcagttcgtccttttctgcaagtttgcccaaccccatattttttcgaccttgagacttatcgttcacgcccgcaagattgtcggcggcacgtaaatactggtcgtgaggatctgtcgcagcgacgtggtcagacagtaacttatctgcatactgcccaacttcaatcgctttatcatccacatatttccgcgttgccagcactacagacggatcaatttttaacgtgactgcctcggtgctactgacaatcagcaccatgcgcaccgtctgtgtgcgaccactgccctcctgcaactgcggcttgtaggtctccgggcagttagcaatggcgataagaataccgtctttatcaaacaggccaatttcacgtatccaccaaccgccgtccgtttcaggaataacctgttccgcgataatttgactgctgttgacctcatcaatacttaacgaattcagggcagcatggcgcttttcgccaataagctgagtctgtgccgggttcggcgtggggagcacaccgccaccgtccccaaccgccatgtgtgtaatctgtaactgggtaccgagggctgttgcattcgccagtttggccgcccccagattggtcattaaggcataaaatttagcggtcataggctcactctcatttcatcaatcaaatgcacaacaccggcggtatagcattggccggtcacggtaatcacttcgggtaaataggggtaaacagttaattcgtcaccgtcatagctggcgacactcacagggatcgcgccattgacatccagattaatagacaggccgaccaggtgacggctacatggtttggcgtcgtctatcagccgctcaagctcaaaatacatttcatcggtaatgccggtttccaacacgcccacatccaggcgaaaagtgccgggcgtttcattagtcttccaccactcgatcaccttgatgagatagccgagcggctccaccacgcgacgaatagcaccaatggtgcctttgtgtttatggacgacgtacgaggcgttaaccaccgcgcgcttggtcgcttccggccaaagctcatcccagcgatccactgaccacgcccaggccagataaggcagcaattccaacggacaggtgtcggcattccacaatttgcgcagcggtacgtcaatgtcagccatgcgcgcacaggcttgtgcggcggcgatctccagtggggtagagccaaccggtaataagcgtttattcatcggagccgcccgccgtcaaggtataaccaatgcagtgagcggcttgcgttttgtctaataccacatcaatcagcggcgcgatcagctctacccgctgcacaccttcaacatgcagcgcggcataaatagctgacagacgaatatcacgccctaagcggcgctgggtgctgatatagctttgtaatcgggcttcggctgcggcgcggattggctcagcttccggccccggataaaaatagagcgtggcgtcaatctgatactccacgatggtggcagaattgacggttaagcggtcagctaccgggcgcacgttctcatcgtttagtgccgagaaaaccttatccaataaatactgtgtcgcggtaccatttccctcacgtgaaagcacggtgacggtaacgcaagcgggggatgggctaatcgcggaggcgtcagcaatccggccatcggcactgcgggcatgatactcatacgcaccggttggcccggcgacgctcaagccctcaaaggcttgcgggatgcgtacccggaaatcgtcgtcagactccatcgcggcggcagtgggcgggatggcgtctggattggccgaggtgatggtcagtcgctcaatgccattgtttgcgccgaggtggtccaaatcactgccatttgcgtaggccaccatcaccgcttgtgccccttcattcactcgctggcgcaacagcaactcgcggtaagcggtttcttgcaataacttcacgatgggttcagattcaaatgacagcgttaatctcactgcggcttgctgctcggacggatataaggcaataaaatcttctttacgcaatgcaagcaggctttcaaaatccagtgattcaatcacccgcggtgccggtaactgacttaagtcgatggtcggcattattaacctcctagtggcacggccaaactcaaccggctgtcgctgtcggtgcggctaccggttaaatcaacaatcatcttgccgttgctcagcgtggtaatactgatggcattcagcgtaacgcgcggctcccaacgcatcacagcgccataaacagcggccatcatttttagacgtagggcgggattttgcggctggtcgatcaaggttgataacagtgagccataatcgcggcgcatcacccgcgtgccttgtggtgtggccagaatgtcactgattgactggcgaatatgatcaatatcgtcgatctgcaagccgctgttacggttcatgccgctatatttataggttgtcattttgtccctgtcgtatcagcgccaccgcgctcaacaccgccgtggctgtggttatcaacgatcacgccattagatgaaaactgaccgccggaatgcctgatgtcgccgctcatctggccgccgcttttcacatttaaggtgtctgtcgtcaggttgttggtgcattccacttcgggtgtgtccagtgtgattttgaccgaggcggtacaggtaatgttgggggcggtagcatggatagattcgccagcctcaatcaccgccgttgctattccggttacggccaggtgactggtttctggctcgtactcaaaacgggcaccatcagggaaggtgatcacgatagcgtcggcggattgtgacggggcgggattggcatcagagaaaacagcgggcagcacaaaaccggtggtgagctcaccgccgatactgatcaccatgacttgctcacccagcgatggcgcagaccaaaaacgcacccgcccggcgcgcagggttaaccaattaagccaatcggtttccaggttgcccattttgacccggcataatccgttagcaagatcgacgtctgagacgatgccaatacggataatgttagccaacaggcgtttaaggccagcaataaggatattcatacggccagtgtgccgcctacgggcgcgcgcggcatgtgatgggttttgtgtgagggatggcacaagagatctaaggcgagaataagaaaataatagcgggttattgtatggagttttcaaatggtagctgtaaaacagctacctcataggttttacttcaaatatatttatcaggcattattttacatgacacaaaaaatacaattactattgttagtaatgttaatttgccaaaatgattagggaaaaactctaaataaaataccgaaaacaaaacgataacaataaatggaactgttgagaacaatatgttatagaatatatttttcactatcgacccatatcattaagtatattcacaacttcatcaaatgttaaatttgaatttgaatgtattcttctggatgccttggaaatgatagggtcgatatatatgtataacatctctatgttattggcgcgcaatgaattatagtatcccggatcaattatttgcaatcttcttgctgccattgcggatttttgaaccttaccatacaaatctatacttgtgattaaaaataaaccttttctgtttatttctgttctcactatattggacatagatattgattcagagactgttttagctatagagtaagccattgccttcttagtggctgttgtaactgaaatcttagcacctaaattaacagaataataagtagtactgcgcatattttcacggggtgtattcttttcaagaacataatcgatataaagttttatcatgtcatagataacatcagaccttttatatatttctgatattgccttcattactcttttgtcttccgattttatctcttggcattcgcttgcatacttttcaaagaaacaggatgtataccaactggctctttcagcaccactatatacactctcgattgttccttttgcagattttatggttccttttatcccgcgatctagtgatagtgataataccctgtctgcatttagtttttcttttaaataaacggaattattcattaaacagcactccattgattgttaataatcgtgtactatacgtaataattatggattttaaatactacaatggagttttacgatgcgactggctaaatttgggacttttcttgttttatttgttgtattgttcttggctattccagaagtgctggtttttgtgttgtcaagcgaccagttcggtgacgctatcagttattttaattttctgaacacgaatattctaatagcactattttatgaaatgggcatcctcgcttttattctttcatatgtaattacgaaagtgattttttatataataaaaaaataaattacttatagataataattacttagcaagccactccaacgccagatccccaatccactcactatcgccgtcagtaaagcctaacaactggcggcgttcgtatttcactgttggcccgttctttgtgactttatcccgcaaaccgtaatgatggactctaaccatattattgaccttgccgctgaacgcaacagcggcctcgtcggcgttggattcgtttttgatataacgagcggtgcgcagtttggtaaacatcttgcgtttgatgcggccttgcttatcgcggcgctttttcttacgcggaacaaagggtgagccatccgggttctgttgcgcctgaatgtgcttttgttggcgtcgccgtagttctttagcgacctgacgcataaacgcgccgcgcgcctgtggggccaattgtgccaataatgttgataaggtctgatctagctcatgcacgttattcacgttacccactccgcgacagttttaccctcaatatcaatttgatagctgttgataaaatgctctggtggcaccggttccccaagatgagtaacgcttaatttgccatttttctctttaacgatcacccgttcggtgagtttgatatcaatgctgatatcgcgcactttgttatccagataatcaacttcaaaagtaaaactgtcctgacgtttgtcggggttcgccataatatctggctgatgagtgcgcaaccaatgcaagaccgggacaatgaccagatccatatcactggcgtaatcagtcaccaccagatttaaggtgtactgatactcaaaagagagtgacggcgccagcgtggcaataatcgcccctttatcgataaagacatgtaagcagtctgggttttgcttgatatacggcaccgcctttaaaatggcggtacgcagcgaatcaggctttagcatcagcggccccttgctggcaaataaagacggtatcgacctgtgccgcgcaagcgtgcaatgcggcctcaaggcgatcaatatcgtcgtttaaatcaccgttagtttgcggccctgctgccggaaactggcactgtgccactctcggacagccattgacggtaatctgcggccccggtgagggcggggcgctgacgcagccggataatatcatcaggcaggggagtatcagcccagcggcgcaatgtttcattttcacggtataatctcttgatttggctattacgttgcgccaacaactgatccgtactggcaacctgttggcgcaattgggcctgtgcctgattattggcattggcggtcagtgccagcgcaataagttggccgtttttgctggccacctcggccgcttgctggtcaatcatcacttgccgagcctcagacaagcggtaagtctgtacgccaccggcaagcagtaaggcggcggcaatcgcccatgcgagcggagcggtgttgaagagtggcatggtgtcagctcggatattgacgggcgggcaattgaaaatgtgggccgtctttaaaggtggtccagttaccgccccattccacggcgatcctcagctcggcagcggcctgtttcattgcgtcagccattggataaaaatatttccactcccaactgaccttaccgcgtggcagcggtacaatatctaccgcatggccggttaagtggcggctgtttaaggtttggctggctccgactttgaccagttcgcgctggcgttccagcgtgcgacagccctcaatcactttaaaatcaagcggggtcagctccagcgcgcggcgcaccactttaaccaaatcaggatgtacgccgatcagattactttcgctggctttgccgagaataaatttattggttaacatcagtggttcctgcctttttattgatgattttgaataccagctcgcggatagcctgcaagccaatcagaccgatcaaacaactgataaaaatttctattttcccggcggcgacctcggttaatgcgccgtttagccagggaatagcatcaatcatgcggatcaacacaggagaaatgaccggaccgatattgacaccgaccagcccacatacgaccccctcgccaatcccttcacgtaacttaccgccgccccataccacgcggcgaaatgccacaataaaagcgataagaaaaccgtttatcgcggttgagtaggcagagtaaaaggccagtaatgcacccatccaacccggatctttgtctggcattttcatatccgttaccccctatggggattgtgtagttagtcccaaagttgcacggtttgcgcagtgatggcggcggcgacttctggcatttccaccgggtaaccgtgcggtaaaaccgggccgatatcggctaaacccggattggcggccaacactttttcagttacaccctcggtgcggccgtagtagcgccaacacatggcgtcaacggtgtcgtactgctgagccagaatgcgcattaaatcagctcaaccgtcatgcggttgatcgcctgaatatcgttaattgcccacgcagcatcacggcgcaaattatcaatagtgggttccagtgaatcggcccgcttgccgcccgtgccggtggtatcaaaaccgcgaaaacgatcagttagacgggcttgcatcaggcaaaataccgcggtgcggtacaactgaatgcgagtgctctcctcgttcagtttttccaccggtacctcagccgctgacagataaccctgtttttgctgggttaagcgccagattgcgagccgatcattcacttcattgatggcaaacaatgccgcttcaataacacgcggctgcgtgatggtgccgtcctgacgtgattcttcgcggtactgtttcaggtcgatatcaggccagaaaccgtcatttttaatgactgtgttttccgctggttccacgggcgctggcgcttctggtgtctgattggtgttaatgacaatttccatgccgacactccaaaaataaacgggcggtgaacggtggctttgccagagtaataaatattctgggttagccagcgtgccgccctcgccggggcgtttgggtgattaggctattttatttgccattttggacttgggcagtgctcgcaatcctcacgtactgcgtgtacgctccggttgctccgcgctgtccgcgtccaaactgcctgcaacaatcacgcctaatcgaattttctctaagacgctttaatcagcttctcaagattcttgatatcggttttcacaccgctgttatcgtccagttgcagcgccgttttcaggtttgccagtgcgagaacgttgtcgccgtcctgacgcagggcatagccgacaaacttatgcaggcgggcgctgacgacatccggcatatcctgaccggttaacatttgctgggcgcgcaatagctgcggggtatccagcggcttttcatcggccaaggtttgccgtgcaatggcggcgacttcatcgccaatcaggcacgcggtggtgcgcttaaagctgtcgggagtcaccaagccatgctggacggcatactctgcgatatctaatgcgttgcggatatcgccaacgtcaagatgccaaatcaacatgcgcatcagaatatcgtcctgttcgccactgccttttgccaacacaccggccacccacggttggtatgtgggtaacatgccttgcttaacctcggccttgcggctgattgactcgataaggctcaattgggccatatcctgttgcagtttgaacaacaacagctcgtagttgctggcatggctgaggcttgccgcctcgctcagtgatgatgattgctgagccgcgacaaatagccgatggcggcgaacggggttgctcataatggattaaccctctgctgggacggaaaaatcaccgaactcaatgttttcaatcagggccacacagccaaaatcttcaaccacgtaggcctcgttaaccgattcaaagttttcaatacggtcacggcgtgggttgtcgatgattgagcgcctgcgggtgccgtcctgccagtaaatagacaggttatctagccgggtgataaaaatggcatcaggcgggaaagacggcgcacgtactgcgggcagaccaccgatacgcttctgactgataatcaagtcagcggccagcgcttctgtgttcggctgtgattggttgacgataggaaaatatttgtcggccagtaactggcggccggtaatcgcgacaagctcggtatcttcctggaaccagggctcgatcagttcatcggttgcagccatcaccagcgcatccagattattgaaatcgccgcctttgccgatgcggattttaggcgagataacatcgcctttatcatcaacaatcttatccatcatctggcccggcgcatcatcacgaatgctttgcagccagccccggttgacatcttgcaatagcttattaacggtatgatcagaggtttttacccgcttgataccgttaaagccgatcatgatgcgatccagtgcctggcgtttcacaatggcatcacggatgcgagtttgaaaatcagggaatttagcccacatatccaatttgatataaggcagcgcggtatcaaagttagtctgggtacagttgtattttgtcccatccagaccgctagggtctgatgcttcacgttctttctgcgtggtatctgtggtgctggcaatcgggcggtcaatacttaagccaaccttttcaccctccttctcatccactggatacatgttgattttggacaggaaaacactgctctcctgttgtttggtttccagtttttgcgcaatagacggctcaacggtaaatttcgcgctgatatcctctttattgtccaaaccgttcaggctagcaacctgctggcggtactggttgtactttaatcgggtggtttttttcatgtgaaattaaatccttaacgtagcaagcgaaatgagttagcaatcagtcagaatggcgctgtcattgccggttgatttttcgcgttgagagaagtcgcgatctgttttgctgagcgtgattttcagctcatcaagttcctgtttggtcgcatcattggcagttttaagctccgtaaaggaccgctccaaggtgctgatagccgacaatttcccctcaacttgctgcgcgactaattcaaccgcctgatgcacatcgttaaaacgtgcgtcatcaccggtttgctttttggtaaacagggttttaatggtggtaagcaggttggttttaggttcttgctcggtttcgaattcaatcagcgtttcttctgcggcggtaaacaggttctcaggggcttgcttacgggaggccagcggattagcggaggcgctggcgctgaaattcaacatttcagtacccagactggcgggatcatcagtgaccgcaaggccaacaagataggcactgttggtgtcagcaaatttaatatttacttccattgaggtgtaaaccttttggcgatccttcaccatttctaccaaatcggctgtagggctgatttcggcatacagtgccattttccccgataacggcccgtccttgatttcttcggcactcaggcccgtcacatcaccatagcgtttaaaggtgctgtctggtgaatagcctttgatgtgctccatattgattcgggcaccgtataccgtggtgttgtagctatcggccatttgcgttagccattcgcgggtgatggtgcggccatcagtggtggcaccctctacgccaatgcggaatttttttgcttttacggtcatgcgtgatgctccggtctgattcgatacagtagtgacctatgttggcgaccggcgaccaacggaacaatcaggcgctcttgtgctatggctggcacaaggtgtaatgcaggatgggggaggtgcagataggtagccttgctgcaattaagtaataaagcaggctatttcacatggaaagcgtttctatcaatgccgatttagatccccgccgtcaagccatgtatctgtattggcaagggctgcgtattgcccggattgcggaaatgatcggtgagaaagccgtcacggtacacagttggaagcgccgcgacaagtgggacgcttacgggccattggatcagatgcaactgaccacggcagcggaatattgccgacttgtcatgaaatcagccaaggaacccaaagactacaaagagattgatttgctgggccggcaagccgaacgccacgcccggatcggtaaatacaatgatggcggcaatgaggccgatctcaaccctaacattgagaagcgcaacagcggaacacgtaaggcaccccagaaaaatgtattcagtgaggcgcaggttgccaagctgaaagatattttcaatgaatccatgttcgactatcagcgcaactggtatgaagccggtttatcgcctgatttccgtattcgtaacttcttaaaatcccgccaagtcggtgcaacctactttttctcatgggaagcgctgcttgatgccctcgacactggccgcaaccagatgtttgtttccgcctccaaagcgcaggcgcaccagtttaaaaactatattgtcgccgccgcacgtcaggtggatgttgatttgcgcggtgaggtgattattttacccaatggcgcggaaatgcactttctcggtaccaacgccagcaccgcacagggccgccccggcaatctctatctggatgaatatttttggatacccggctttcaaaaattgcgccgagccgcatcgggcatggcatcgcagaaaagataccgctccacctatttttctactccgtccagcacctcacatgaggcttatccgttctgggcgggcacgctgtttaacaaaggtaaagccaaagataaacgcattgaaattgatgtcagctacccacggctggccggaggccggttatgtgaggataagcagtaccgccagattgtcactattgaggatgcactgaaaggtggctgcgacctgtttgatattgatgagttacgcaatgaaaacagcgatcaagattttgaaaacctgtttatgtgcggcttcattgacgataacgcttccacgttcaaacttgcagaaatgcagcgctgcatggtggatagctgggaaaaatggacagacgtcaaattgctggcgctacgcccatttggtgataggccggtgtggattggctacgacccggccagcaccggcgatagtgcgggttgcgccgtcattgcaccgccagtggtggcgggcggtaagttcagggtattggagcgccaccagtggaaagggatggattttgccgatcaagccagcaatatcaaaaagatcactgagcgctataacgtcacctatatcggcattgatgataccggtctgggccgttccgtgacgcaattagtacggcaattcttcccggcagtgaacgccattcactacagcctggaaatgaaagccgacctcatttataaggcaaaaaatatcattcatggcggccgtctggagtttgatgcgggctgcattgatatcgccaccgcatttatgtctatccgcaaaaccatgaccgccactgggcgaaacgccacttttgttactagcagatctgagggcgtcagtcacggcgacgtggcatgggccattatgcacgccttattccatgagcctcttgagggcattaacagcaataacaccagtgtgatggagatatattgatgagtaaacgcaacaggaaaacccgctcggccaaggtgacaacagctatggcgggcaatagtaccgcacaggctgaggcgtttacttttgacgacccgatcccaatgatggatcggcgcgatattctggattatttggaatgtgccgtgatggatcgctggtatgagccgccggtgtcattcaacggtctggctaagtcatttcgtgcggcggtgcatcacagctcgcctatctacatgaaacgtaatgtactggttagcctgtttgagccgcaccggctgctatcaaaacaggactttagccgctatgcgctggattttttggtattcgctaattcgtttttagaggcccgctataaccggctgggcggcatcatgaaactggtacccagcccagcaaaatacacccgccgcggcgtggaggcggacacctattggtatgtctcatcctatgccaacccacacccgtttgaagccaatagcgtttttcacctgctagacccggatattaatcaggagatctacggcgttcctgaatatctcgcctcgctaaactcgacctggcttaatgaagcagccactttgttccgccgtaaatattatctgaatggcagtcacgctggatttattctgtatatgaacgacgccgcccataaacaggaggatatcgacgccttacgtaaggcgctgaaagaatccaaagggccgggcaatttccgcaatttgtttatgtatgccccggccggtaaaaaggacggcatacaggtgatcccacttgcagaggttgccgccaaggatgaatttgccagcattaagaacgtcacccgcgacgaccagctcgctatgcaacgggtgccacctcaactgatggggattttacccaataacaccggcggttttggtgatgtagaaaaagccgcgcgggtgtttgccattaacgaactggcccccttgcaagaacggctgatggaaataaatgattgggttggggaggaagttgtcagatttaagccgtatgaattacttgccaaacaagagtaaatccaacttatgcatatgctaaccgtcttttaggcggtttttgcatttatatgcacatgaaaattaactggccgccactttatttcttatattgagaattgtttcagtcacaatgatgaaaattaaattgcttgtgacatgtcacaagcctattgattttatttctgtgccatgtcacgattttaaaagagcaagccgcaacggccacctcgaaaatcagtgataattgcccaaattatttagtaaactgaccactgcaaccctgcaaattcaaagcgcaacaatccgcataattctattcactccctaatcattatctaagccgcgccaatactggcttttcagcctctttctaactgcatgaaaagtgagtatctagtcattgcaaagcgcgggcgggggggcgcgcggaacggggtgcggttggcccccgcatccattctcatatgggttcaaaatcccccccaaaacggccatgcgcagccctagtctttcgatataaaaagtacatcattgtaggtgaaatgaaaaaagcacctctctacgtggcgtggaggcgctttggtgtggggtggttttgagagtaaattgatgggcgcgtgtattttattcaatttcacgcatatgtattcatttaagtgacttgtgcaatattgccgtggtgcactatcagcactcgcgctatagggtgtccaacatcagtttcttataccccaacgtctgccaacacgccgtatcaccttgaaaacaacaaccgtctctatcacctggcaatgtatcaccgcaccgcttgcaactgtctttcttcaactcagcaagctgtttgtgtagcaatttattgtcctggcggagcaagccgatcaaatactcggcccgttcataaggcccgcgagcaatacggcgctgttcgcagccatccaaaagcattgccatttctgcggtatctatacgtaaggtaagttcggtgatgcctaactttttatcgcgcaggcgctgggcgcgtttacgttcacttgctgttgtcattttttgtacccctgacctttttccgccagcccacgaattgccgggcgggctaatatgattctctggcaatcgtgaatagctcggcagaactcatcacgttcacagggatgctcaattgaaagctgtaaatattgattccatgcatcgccaagcatttgagcgactcgctgttcatcggctgacaatatacaaatggtgtcggtgtaattaatgttggtgactttcacggtttactccctctcgcaattttgccacccggctcattacgctaaatgcccgttgggcggtggttggttggcactggtacaaacaacaatcctctcttgcccgccagttctgaccgccgatggtcaatgttgcgccgcaagccagtgattgcgcttgttgttcgctaatggaaagcccgattgactcggcaaaatcgcggatttttgttgccactggtgccagtcgtgcggttttttctcgccgctgggcggctttttcggctgatgcctggcgtgataattcttcggctggcgtcaatgcgttggttttaatcgttagtaccggcgcgctttttatcctgcgcagcaaggcccgacgttctgcatcggtgatcgcggtgaaatcgattattttttcttctaatgttctgtctatggcctcatccggttcgcgtgttttttgctctaccggagagttattgacagaactccaagggacggcggggccgtcctgaaaaacatcaaaccccacgacaacggcgggcttcaccttttggcgggcgacaattttccaagtttttaggcgagtacagatgcgcgacgcctcacccaaaagcggggaatagatgccgaaaatcttctcggtgatttcgccgtaggcgttgggctgttcattgtcctgataggcaatgcgcacggtgtaatcctcacgtgggatcagcacgccgccttgcttcatgatgtaggtagcaaagcagcccgcatctgcggcggcggtgacggcatccattgccggatcgatcaataacggcttgccgcgttgataggtgccggaaatcttgagcgtagtgaccagttgattgctcagcttgcgcagctcccgccagacggttaccggtggtgtgccgattggctgatattgtcggatacggtggcgtgacgcccaagccatagcgaagcgggccgtctctttcagcggcttgccggtttcatggtctagttcgccatccagcgcgtatccatcaatatttttactgatgtatttagcgatataggcggtggcgctgcctttcttcggatcaagccgcttagcggtaaaccgggcgctggtgcgcttacctaattcggcgcgatcagttttaacggcataggcgcgcataatctcagtgatggcgtggcgttcttgcggcttcatgaataacaacaagtgccagtgcggtgtaccgtcatgatgcggttcagcgacacggaaaccataaacgcgcagattttcacggcctagcttggatccgatattggcccataactttgtaagataggcttgtgcctgtggtggcgtgctgtgattccacttcgggttagcgtggccgctttggttgttggcgtggtatttagatgggcaagtgatggtgtaaaacaccccaacatccccacgcgactgtgcaaccagttcgatcccttgcatgcgagccattaattcatggcggcgtatcgttggattgctgatactggcatccaccatcgcctctaaagaaacggtgttaccctcatcatcaactaattcatgtcgcttgaagaattcgcgattacggcgtttttgctctatccagtcggccaatgcctctttactgacatagggtgcggcacgcttgtggatcaagccagcggcgcgtaactggctttctcgccaatcattacgcagtcgccacaatttacgctcccaccaatcggggttaatcgatcgggcaatagcggaatagtagaccgtgcgatctactggttcatctggttgattgggcttcggccccaactcgcgccagtgcggcggcctgacccgtaaagaccacacctcaagcgcaatattgcgataaatggtcaataactcggcatcagataaaatacgggtttcttcggtgggtgttgatacctcagtgcagaacatttcattaatacggccagctacctcactcgccagcgacttgacccggcgcttgttcagttcggcaaggtgactatagataccctgaaaataggccattaactcagaaatacgaccctggctaacgccttggtattggcgcacggcatccagacgtaacaatgcattcttgccggtaccggttaagaatgcattggtatgtttatcaccatgattttcacgtaaccatctaattttattttgaaagtgggacttaataaatataggttgctgatcaatgcgggcttctacaccttgcggtgaatccgcccattgttgcttgtccctcaaatagatctggcgctcaagcgcggcgcgctccttacgaatcttaagcaatgtgaggttaggctcccgtagctcggtatagcccagcgcattcaggcgttttacgtaacggataaccagcgggtgagattttggttttgctaccactgcggccggcactaaagattggtgaccaccaatcgcggggcgcggggcattccacggatgatcccatttaatagaaacatcaccgctgcccggataaggcagcggtggagctggggtgatgcggccacgggaatgcgtggtcattcagcaataccagccagatcaatacctatccacagtggcgtggctaagtacgcccttatgaacgcttccgccgtcgaagcacccttggtcatattgcagccctcaaggttgcaataatttcacctaccgccttacggccatcagctttgcaactggcagagcggggggcggtaatgctgtgaatatcaaaactttcgtaaagatagcggccgtgtggggtatcgctgttcgatgcaataacgtggcaaccttgatccgctatgatcgtgagtatttccgataaccaaaattgctcattagaactaaaaccgcctgtatggtaactggtgaaatctgcggtagcggatgttggaatgtaagggggatcgcaataaaccacgtcgcccggcatagtcatggttagcgcttcgaaaaagtcacagcatacaaacgtggccttttgggatttctcagcgaaataacggatctcagcttcggggaaatagggcgctttatatcttccgtagggaacgttgaattcacccttttggttataacggcaaataccaccatgacaatggcggtttaagtataagaatattgcggcgcggtactcgtcacttaactcgcgttcattgaaatgttgacgattcgaataataattcgcttcactgttatcaaatttgaaaagctcttttgcaagaacaatgatgctctcgcaatcccgctgtaattgctgatagaaattaattaaatcgtcgttaatatcagcaatgagatactcgtcatagtcagtattcagcatgacggaacaggaaccggcgaacggctcgaccagacgctttccagcgggcagatgttggcgcaaggttggcataatacggcctttggaaccggcccatttcagcggggagaaaatgcgtttcatgacttcacccccgccatagcgcggataatacctagcgttgttttgcaatcggcaagcgcacggtgtgcgacaccatcaataacaacgccttgttgctcggctgcattactcaaccgttgccatttaaacttattccgcttctgatcccactggccgtaatatttggcgtaactttccataacgcactcggcatcaaaaatatattttttctctggcaccgggcaattattagcagccgccgtttgaaaaattaaacgagagtcaaatagtgcattgtaaataagcagagtacggtcattcgtcagcgtcatgaattgataatgaatatctcgccacgttggtgcatcagccaccatttcattagtaattccatgaatggcggttacctctgcgggaatggcttttaatggcttaacaagcgtatccagtaatatctttccagtacaatcaatgatactgatttcaattatttcagcatcattaccaaggcccgttgtttctgtatccagaataagataattacgtttcaaccatctgttagcacgattatgtgcgccgtagcggcataaagcctgatagattttaaagccagtttttttcactgcggcaataaatgcttcaatggctttagctaatttattatttttcatttcacacccctaaaaaattaactccctctaacgcaatgcgccaaagggatatgtgtttatttttcgtcagacggacggttgtatttatcgatattcatcaatacacgcaaagccattgcacccgtctggatagcctcctcgcggacggcttctatatcgccattgttataatggtattcaatagccgctttcattaactcgcctgattcctcggtgagaatagagacagcgtgaactacatcagtcggccatttgggatgtatttttgaggcgcggatagcttcatcaatgatttcagatgaaattgtcatatattgcgcgtaagtggccttccctgagcgacgggaggtaagtccataaataccaggagagggagcgtaatgggtaaaatatgcatatgaatgggcatcgaatagatcgctggtaggttccacttttaatcttgtcttttggaatgcttccgctgtgcgcaaggcttctctataggctgattcagttttatggatagctgaaataacattgaaagcagtctcgtctgcgtaattggcagcgcagtttttaccgtgtgttgtcgtttcaatcgctgctattattgaatctaaatagcccgatgctttcattgcagcgccagacgcaatttttacctgctctttcagtgcgctaatagaggccgattgactatttaacataccttctagttgcgcaagatcggtaagcgctctttctcttgtcagcattgataaagcgatagctggactgctacttatgaaagcacgcaaatatgaaatggtaatatgcgcagtgttgtttttttgttctgtcatgttgtatggccttattttagataataggaagcccgacgcagtaaatacgccttatttaatcactcgttaaaatgcgatttatttataacaagtctttcgggattgaatttaaatcaacccataaatccaacgccgctttacgtactgcttttctttcatgatattccaactcacggaattttctttcatggctgtctttctttatcccagccgcataataaataatgccttttgttttacctttgctcaatgattccaaacgctgctcaaactcttcatctggatcctttttaaacagttcctttatgcggtctaaatgccgtaaacctactttctgattccattcctgcattgaaagcggcgaaccgtccgtattaatttgccccatcattcacctctcggtatgacagtaattaactcaataatgtgtcggctctgaaatacccccggaattacactgagtcaccaacagctctaattcctgagcgctgtcctgatccccggatgcttgcgccgtgcttaacagaccctccagaccgacacttagacgaaaggcgtaatcatttagcgaaaacattcgcacctcgtcggcaacagcggaagcggcgcgcaggttttcggccttgaagtggtattgctgcaacaggtcgttaatcaatgtgaaatatgcttgtttcatccctttctccttaagagtgttggcgcgctttgcgtttgatattggtgcgacggcggtgatcgcggatcacggcgcgggcagacagaaacgcaagccagataagcacggccagcacggctaatgctccgctggtcaattcaattagttgccccggcatgtctgtacctcttcattgaaaaattgaggtatgacgcctgactcccgaaattgctgtgttgcggcattcagttggtggaaagtggctaatttgttttcacgcaattgccacgctatggcggtaatcatacttaagcctgcaagggtgctgctggtgatggcttttttttcacgagcatggagattagctttaagggataaaacaccattttcctctatcgcacgtcgggttaactctcccatatcagccatgtgtgttcgcagtatggcgttagctatctgcaggcaaggtgatttcatgctgcggctcccgttttacgttcgatatacaactgatcaatgaagccggtggcgagtgcttgagcgtcaagtaaaccgaaagactgttcacccaggaatacttcatagcgagcaatggggttaatagcagttcttggccgatgagtaattacaaagccacgataggcagatgaatggtggctaataatggttaaggcgtgcattgtattttcccctaactattggctatggcatctttcaacatagcaaccaaattaacttcaactttgtcaccagctttaactttcgggcgaataataatccgaccatcacgcaccattccccgacaggtcgcaaaagggataccagtcattgcggcatattctttcagagagacataacccgtgggcacggtgatattaatggtgacattacccataattcccccttatcaatcagcctgaatagcggtgataccacgcaagtaaactagacgcgccatactggaaattgaacgagtttcttttgctgcgagcgcttctaattctgcacgctcatcatcagacaaacgcatatgggtcgggttttttgaagcaattcctttcggtaatcgcgagcgttgatcgtgtttgacttgtttcataatggtatattgtgatccactaagttcctgtacaacacaatttaaggaagtattgttcccatgccaaacaaaaaagaggaattattattcctaattggcgcacgactgcgtgaagaaagggaaaaaacgggtgaaagccaagaggctatggcgacaaattttggtgtttcaaccagaacttggggcaaatatgagagaggggaaaccgtacctgatgctgccacactcgcattgttgaatgctcagtatggtttagacgtcatgtatatactgacggggaaacgaacccctccagatactatctctacagaagagctgaaactagtagagaattaccgagcaatggatgactcggcaaggctaaatatacaggcggttggcgatgcgttcgcgcaatcgaagcctcaattgaagtcgaacaataactagtaatatgggaggttgagttaatggaaatcgtacttattgttcttattgttttaggggtggttagtccatatctgttttatttgataataaaaaaacagaaattactcaagcaactgagaattgatgaagaaaagataaagttagagatcgaaaatcttaaaagtgaactgacatcctcacataacaagtatatagagttagaggaaaatacagctcctttatggaagtataccgagatttacaatgcggaattatttgcagataaaataatttcagatgcgaatgaaacagttaaaaaactacttcatgatgctcataacaagtcttcaaaaataattaatgaagcaaacaggcattcagagataacgataataaatgctgataaacaagctcaaatgactctgggcaatgcgcgtgaagaggctatagcaattactcgcgaagttcgcgaaactcgccttaaagcaaaagagaagttagatgaggcccatacaaaagctgaggaaattatccgtaatgcaaatgataatgcagttagcttaatgaataatgcggaagaaagggctaaagaaatagcaggttcggcgtatgaggctaaagagtttgctgaaaagtatgagtcagtagcaaatgcaatgaaaaataaaataaaaggctatggagatgagtggattattcctaatagaagtatattagatgaattagcagaagaatattcatttaaagatgctggcaatgagttgaaaaaggcgagagaactaaccagaacgctgatgcgcgctgataaagcggcaagctgccagtatgttgagccaaacagacgtaatacggcaatcaattttatactagatgcctttaatggcaaggttgatactgttatggcaaaagtccgctataacaattatggcaaattatcacaagaaataagagatgcattttcgcttgttaattttaacggtggtgcattcagagatgcaaaaataacagatacttttttgcaggcaagattaaatgagcttcgatgggcagtcgctgtaaatgaaattctcatagaagaaaaagaagaacaaagaagaattaaagaacagttaagggaagaagaaaaagcccgtaaggaatatgaaaaagctattaaagatgctgaaaaagaagaaaaaatgatagtgcaggctatcgaaaaagcaactaaggatctacaagctgcaaatgatgaacagcgggctgtgttacaacagcagttagatgagctacagaagaaatatgaagaggcagaagcaaaaaatcaacgtgcaatatctatggctcaacaaacacgagctggccatgtctatgtaattagtaatattggttcctttggtgaagatgtatttaaaatcggtatgaccagacgtttagaaccgatggatcgtgtaaaagaactcggtgatgcaagcgtaccattctcgtttgatgttcacgccatgatttatagtgaagatgcacctaccctcgaaaatgcgcttcatagaaaattcaaacaggctcagcttaataaaattaatcagcgcaaagagttctttagtgtgtcgttgtcagatattaaatcgctacttgatgatatgcatattgaaacccattggacattaaaagctgatgcgtacgaatacagggaaagccttgctctcgctagacaggctcaactagatgccaatcctgaacaggaattggttgttgcctgatggcataagaggaaaactacgtggctgttcgtaaattaactactggcaaatggatttgtgagtgttatcccaatggacggcgtggtgagcggcttcgtaagcagtttgctactaaaggcgaggcgctctcatttgagcgccgtatgatgcagaaagatcaggttgttgaggtttctgtgagcaatacattgaaactcagcaatttagttagtcgttggtatgaaatgcacgggcagactttaacatcaggtaaaacccgaaaggtaaagttagaggctatctgcgaacggttgggtgatccactggtcactgattttgacaagaatacttttgctgtttatcgggagcagaaaccatttcgccactacccgatattttcagggggcgtatttgcttcaggttttttaattgcgcttttaatagtcacatttagtaagtaactcacgctcaaattatttacattgtgatatttaattaattattttcttaaccttatcgagggctagcgatgaaaaaggtactgtcactgacgtttcttatttttgccttattcacaaataacgcatttgctgaaaattggtatgcggggggaaccctgcatgaagccaatgcgcttacatggcaaacagccacgccggaaaacaaacttgcaacttgtgctgactttatcgccgggatatacagcaaaaagctattagcacctgagataaatagaaaaataaaatcggttgatgattttaaaccttacgcgagtgaattagcaaaacaacttgatgatgcttttgctccagaatcagatccaattcaaaataaagaaattttcactaatcaaagtgtcaaatcaaccgccatgatgttaatgattatgatgcagtgggtgcaggattaatggcagtcagtaaacttccgtcaggaaaatggctttgccaatgcttcccttatggtcgtgataacaagcgtatacgcaaacagtttgccactaaaggcgaagcactttcatacgaacgtcgcatgatggtgaataaacaagatacggggctgggcattagtgcggtaacgcttaatgaattagttgagcgatggtatgaaatgcacggtaaaaccctatcttctggcgagtcccgtaaagctaaactattggcgatttgtgagagaatgggggaccccttagcggcagatgtcgataagaatatgtttgctgtttatcggaacgccgcctgaatggtgaatggcaagcaaaagggcgtactgttgtaaaagaagccactgttaaccgtgagcaatcatacttacatgctgtattttcagaattaaaacgccttggtgaatgggagggaagtaacccgcttgatggtatccgccaatttagcgagggtgatcaagagctggcctttctgtcccaagatgaaattaagcggcttttagtctcctgtgatgagtcggaaaataaaagcctgggaaccatcgttcgcctctgtttagctacaggtgccaggtggggagaggcacaggatatgaaacagtcgcagatattacctagccgtgtgacttacattaatactaagggcaaaaagaacagaaccgtaccgatatctgagaaactatttaaacgtataccaaaaaatcgcggtgctttattcactccatcttatgatgcatttaaacatgcattgaaaagggcggctattgagttgcctaaagggcaacgcacacacgtactcaggcatacctttgccagtcactttatgatgggcggcggaaacattttagtgctgcaacaaattctcggccatagcactattttaatgacgatgagatatgcacattttgcacccgatcacttagatgcggccatcgctttaaattcttatgacaagttagttatcgattagaaaattgtcagttttgatggcagcaaaaactagccacacgcaaacatacgcagcgatacgcatttgtaacccattgaacaaccttaacttgttgattttaaaagatagcctcaaatttttaaaatccctcggcttatggctgtgcgggttcaagtcccgccccgggcaccatggaaaatagtctaagtaaaacaaagtagtacgagtatatcgttaaccgccgagaggcggtttttttgtgattaaaatcccattcctgagttgttcctaacatcattcctaacatgttttgtggagggtgaataaaaattcactttttttgattaccgactaccggcacaatttttattttccgatcatatcgtgccgtttgccccatgtttttatgccctgaaattgcctgtttttcactgagtgtcccttcaagatcagaaacacctttagccttcaggtcatggaaggtgaaattaaaatccaactctggatatgttttttgcgacttccctggctttgtgccatttactattaaatccatcacgcgtataccgtaaacctgtacgttgatggatgatatacacactacttatacctgacttcaggggaagggactcagccagtgttatggcatcacgtaaccgttcagaccatgctttaatctgcctggctgccgtcttaccctgtttgatatagatcccgggttctctgagctgatcacgacgcaaagcaaggacatccgcttgccgggcgagacacagataggctatttccattgcaactcggacaacatcaggtgcgacttgatacactgcgtcgtattcctcatctgtaatatagcggtctctggctttctccgtaaattgtttggcccctctgcatggattgcctttcactattccgcgttcatatccccagcgataaacgcgagaaaggaaagttttttcccggttagcctgcgttctgctcgttattcctcgtttatccatatactttcttatatgttcggatcttatattgtcaggggacatttctccaaagactggcagcaatttgagagattcaggttcaaattgaacaggatgctgacagcatcatcatgttgtatcgggaggccatttataaccccgatagcccggcggcaagatttgctgaagctatcgtaactaaaaacagatttggtgaatacggtaccgtttatcaggagttccaaaacggtcactttctagccgttgaccagttggtggccagagaagccagccgcatgtcaaaagaggcaatgaagctccctgtcagagaaaaacggtattcgacagcaaatttttaatcgcacctgacccgcgttgaaacgcgagaggtaagaccatgcggaccatcaatgaaaaatctccggttgttgaattcatggtgtaaccatggacgggcaatcgggctaccttcccccccagacttccgttcaatatttctcgttggcctaaagagtgccaggaaaagctgaatcttgatttgatagccagcggcttaatcaaagacctgtactaacgcaggactaaccgcgcccacgtactggaagcgattgaacgggtaccggtagattatcgggcattttttaaagaacgcttaaattactggcgtgaccggagagaaaatgaatgttagcaaactctggctgtcatgagatgaacaatatcgtcgtgtgacctgttacaggaataataaaatgaaaatcgagtcaggacaggctatagcagggtattctattcaggatgtgggagccttgatccgattcggcttttcgtatgagcatcatcaatcattgccatcccaaatgagcaataaatagaatttggagagtttactgtgattatgaaaaaagttataggattgaaacgaatactcatgcaaatcactttatgtactgagccacccgtcgggaacgccttacgtttatttattgctaagtgggtcacattgttcagtgacattggatggatcaccgacgaaggtatttaaacaatatgttgatttttttttgcttattaatacataatactgaattatctcattataaaagggaattcattaaatgatttatagcaagcaatctgctgatactgtactagaaaaatattttgatgcattcataaaaaacgcatcaaccgtgatatttgatactgttgaaaatttagatttaggtgctgggcgggcatttatgacagtatcgcccgaaattataccggaactaacaatgtatccttagtatgatgaaatcatcaaaaaatacttatctgcaaacagagaactcattcttgtaaaaaataaaagaatggaatagaaatgctttactttctaatagaaaaaaagtgggtgttttaatggattcgataaaaagaaaatcaactgatgaaataattcaagcgctaaagtttattttatgacagaggtttttttatgaaactattacatcgcgtatttatagatttattatttgttgctttagctatgctgtttttcgcgctcttcatatatatgtctggtaaagtacctgaatttttcatgatgtacgtgttctatggtggtttttgtttgtcattttatttttcatatcgtttgagaaaaattttcatgacttaattttaacgttgctaatacataaatgatatttacttgaatgcatgggcgcgaaaattgattggtttaataaactctgtcactccatatgctataacctgatgtgcctgatgtgcctgatgtgcctgatgtgcctgatgtgcctgatgtgcctgatgtgcctgatgtgcctgatgtgcctgatgtgcctgatgtgcctgatgtgcctgctgttttatgttgccaggatattgactcatatataaacgagattttttcaaacggtattgcaccatgattatttattacatgagggtaattttaactgatatctattatcgtagctttagttaattttatctcataaaatattcccaaagcaccaaattgatttaatctataaattgaaaatgatggggttaatatttcattattggatatggctatagccattagtggtgataatttgtcaattggtttgataaattcaacaggatgatgtgtacaatgttgctctcttgttatggcgtgatttaaggatagtatctgaatttcatcgtcatgatcattctgatgtcgatttccaatcgagtcaaatgaactgcatccagcagagattaatccttgttcacttcctgttaattttaaataggtattaaaactcataaaatatccttatagactcagttgtttggcttaattttataaagagtggtgttcttttttataaaatacgaattcagtattttatattaacttgatatgtttatttttttaatgtaaacaactcaaaaatgaaattttaagatatttcttgcttgtatggctgtcatactacatgtgcgttggcggtaagtgtcaaggtagttgtcaccccaggttgatttatgcggcctgttttccccgctctggatttaatgtcacgctttcctgccattcccagtttcgcgtctgtcgtgaccaacgtgtcgggttcgcggctctcgccgcttgatagaccttatatcgttgggccaacaacgccttgtcctcacccgtatgtcgctgcaacggcgtcacataacctatgccactgtgccggtgctcttcgttataccaacgggtaaatttatccacccagacccgcgcttcctcaagatggttaaagcctgaggatggccactgaggaacatatttcagcgtgcggaacaacgactccacatacgcattatcattgctcacacgcggtcggctgtgtgaaggcgagatattcagttctgccagcttcacctgcagggtctgcgacttcatcgccgcaccattatctgcatgcagcacctgtggctggcgataacagcgctcccgcagtaccgtacgttgcatcagcgccgccgccaactcaccactctcggtttcatgaacttctgctccggtgattttacggctgaacacatcctccatcaggtacagataataccaacgaccccgtacccatgaaggcagccacgtgatgtcccacgtccacacctgacaaggcccggaggcggtgaacgttgttggcggttttacccggcccggcttgaggcaacggccacggtgatgtacttctccatgacggcgcagcacccgataaaaggtcgattcactcgccagataaacccctttatccgccaaccgtggcacgatttgcgacggcggcaggttggcatactcgggttgatggcagaccgcccgtatctgctgctcttcttccactctcaggcgattggtgggctccgggcgtatcgccgtagttctttggtcttccggggaggtttgccaccgttgccaggtccgtacgctgagctcaacttcgcgacaggccaccgcccggcgtgcaccagcagcgacggcctcatttatccacgcgataaactgctggcgttcctctcggggtgtcagtcgtcctcgtccgtttccccgtagtagtccctgagcttttttcttaacaccaggatcgctgccgtctccgccagcgccttttctttacgcagcagctcctttttcagttgcttgttttctttctggctttgcttgagggccaccttatcgtcacccgaaggaacctgcaaaaaagcctgtttccattgcgctatctgcgcggggtaaagcccttttttacggcagtattcggcgatttccgtttcacttaacgtggcggtttccacgataaccgcgagccgcgcttcggcaggccactgttcactgtttttctctgcaccgggcaccggttccccctctgatttagcctgattgcgccaattgtagagggtagcttccgatatcccttccatctgtgcaacagccgtgacggtcatgttgtacgggggaagtaattttgccaatacaccggctttacgttctggggaaatacgttttatttgtcactccgttgccctctggatccatttttagaagggggtgacaactatgctgacactgagggctgtcggaatttgctaaacgccccgaataataatttccgacagcaaaaaactagttgtaaactatttatttgaatttcagaaagtacaaggctattaaaaacattattatttaattcatgatttaattgatatcgaaacaacttttgttggtatggagaaaaaaccgattaactacaagtgttagctgaccacgtttgacagtaaatcatatggtattcattcatgttcacacaagactcacgacttggtgttgtcacgccagcccaacccgtctgaaacgtacagtaatgggctgcattacttcctcctgcctgagtctggtaaggtgctacgggaattttagttgatggaaatacagaattactgccattgataacttcaactctgtcgtcagcccaatcgatttaagtttaatagtggaagatggtgttaaattaaaacctgcaatgtataaataaataattataatattaatgtatcaggttggtattatactctcaataaaatgtaactaaatgtaatatatgaagtcgtccctcactacaatccagattaactatatgaatagtgactggaataatcaaataaggctaattttaaagcactattgaaataaatgttgatatcatgttactaattatattgtgctcaaacataagaaatccttctgtgtatgatcgcttatataaatttaggagaaaacatgcaccaatcagagatcaagctaaccaagagacttaagataaaacgtgttgatgtaaacaaggttaaagaacagcagaaaaaagtattggaatgtggtgcggcaacgtgtggtggtggtagtaactaattctcttctcaacgtggcgatattattatcgccacttattagaaattggatagaaataatgataatggatgcacaagtaaaaaggttgcttcacggctgtgcaggaatgaattcggttcgcatgatgactggttcatttcatgttttttatctattttctttgggggtttcagtttcacaaattgctatgctacaaatgatatttagcgtagcagtatttttatttgaacttccaacgggaatattaggtgataaacttggtgtaaaaaaaaacgtaataatctcatgtggtttttatgcagcctttttcccactctgtacctatgctccggatatgtctttgctgatacttgcagagatctgctacgcgcttggtgcctgttttatatcaggtgcagatagtacctggataaagggacttgtagataatctttcaaagaaagctgatgttgcctatcaccactatatttcttatgtcagagaaattaatgcgctgctgaattctatatcaggagcaatcggagttttaatcgtggtggtgcttgatagcttcagtagtgtttattatttatgtggagttctatttattttactgatgttgctattcagtacagtcaactcagttgaggataaaattgatgttgctgtaataaaagaaaagtttagtgtctataagcatatcagagagtcacttcgtttgcttttttccacgaaagttggtgtctattatattttgatatgcggttttgtcgtaggagccattcagccagtttaccatttctggcaaccatttattcttgagcaaactgggttaatagacaatacggataaaaaaaatgagatcatcatcttaggcatttgtttcttctcatactcttttacaaaatacctttttaatagatatctccggaaagtgatttttaaccactatcaacctatgaccattatcctggctactacaatgctagcagcatgcactatgctacttctgcttataataaaaggcacctggacgccaattattatatttactttattccattgtttcttttctgtaccaatgagtcaatttgattctgagtattttaagtatcttgataagaaaaattccaatactgttttatctataattagcttgatagcaagaatttttggcattgtctcattgggtatcatcgggttattgtccagtagttttggtctaacttcggcttttgcattttctctttgttgtatcattggaattatacccatcacaattatgtggacactatacaaccgtaactattcaaaaaatgaaaaaatattattggaggaatttaagtgagaatacaattaaatcgagcacttcctttgacatatgataagagcaataaaaaaatagttgcaggacagactttccatgacctaatcgaaatagacgattcacctgattttctttatgagttgctaacagatttaaatgtggaaactgaattaagcataatcctgaataaatataaaatagtagcagaagagtcctcatacgatatcaatgagatcattgaaaatcttcttgaggaaaaaataattattcatgtctggcaacccgaccgttatgatagacatcgtttatttttcgaactatcaaaagataatcatgaaaccacgatgtcagctctttctctggcaaccgttggcattatggggactggtggtattgggtctaatgttgcaatactactagcagcggctggggttggcaaactcaagataagtgatggtgatctaattgaagaatctaaccttacccgtgcgactatatttaaagaagatcagataggaagcttaaaggtagcgtcgctgaaagaaaatatttcagaacgaaataaaacatgtggggtagaggttctcccattattactgaatgaagaaaatatggataaatttaacgcatttttttcagagtgcgatattatcgtgttatcagcagatcctaataatgtttttgaacttattagtatttttcatgataataataacatcccaattgtcaatgcgggatacttaggaaggcttggcctgatcgggccaatgatggatgctacttccaatccgggatttaaggagttatttactcgagattgtgaagaaaatcgaactggaaaaatactcattaatcgccgatatcaggcaccatcttatggcccactaaattatatggtttcatcaatctgttcgcatgaagtaatacgctatcttgccacaaggaaaagttgtgtttggcaaaaaagattactaataaatcctgacacctatgaaacactattttatggctataaaataacagaagataatattgagatgaagtgcgatacactcaagccgggtgatgagacagtttttaataaaatagcagggtattatagagagcatcgtgacacatcaagcacgaataaaactgttcttgacaagagtgttgcacgaatcctgacagaaaataaatataattcagttcttgatgttggttgtggtattggtacgtattgtaggatgttggacggtaaatctagttatattgtcggtctcgatattaacagttctatgctttcaacagccagggagttaggcggttcaattgaatatagcaatggcgaatttatgaactatgatgataatcattcctttgaccttgtcatattttctctggttctcgaccatgtagaaaactttgtagattatatcctaaaagcaaaaagtctcttgcataaaggtgggagtattgtatgcataattcctaatcctgttaaagattcatgtttaagtaacgaaggtaaatatatggaggtcactaactattttcatgaaggagttcagagaaaaaatcgttacgatgtcaatgacgagatcttatgcgaagttttatcatttaagcgaacattaccgacctatctaaatgcatttttaacttcaggttttacattacattatattgaagaaccgagacatcctgatagtaaccatcgtgcacatcacattccttattttacgattttagagttccgctatgaacattgataaaatatttgaaaatccatctaatttaaggtcattcgaatttaataatgatgtttgtaaagtgttcgatgatatggtttcccgcagcgttccgggctatcacaacattcaggatattatctctttgacttatgatgaattctctcagaatagggtttttattgatgtaggttgttctacaggcacaaccatcgcaaaaatcctgtctgaaaaccaagtaaattactgttatggaattgatatctcagaaagtatgctagcaatagcacaagaaaaatgtggtgaacatgaaagtctggtcacctttaaaaactgtaatttacttaatggtactgataatgtaataaactcagaaaaagttccagacttcataatacttaacctcgttttacagtttattagaccaccagaaagaaagaaattcattaccaatataaaatcgctatgctcaagttcaaccttgatgctcgtttttgaaaaaattattttcaatgacgccgaaattaatatgaaatacatagatagttacctaaaatggaaaggtaagaatggctattctgaatccgaagtttctaataaacgtaaagcactagaaaataaactcatcccatatcttcatgaggaaaacattgagctatttaaatcctctggatttaattctgtcgaaatatgtttttcattccttaattttagagggtatttatgtcgatgctgatcgctgatatctataatgatacactttattatcctctaagtgaatcagagtatattgtattcttctgtgcttctgagcgaaatgccagaatttataaaaagctgagatcaaatccgcaagatattatcgattcccttgcgaaaactattagtcaagaattaaagttcgaaccgccagcgccttacctgactgtatctgacattagggtgattaatgataatgttaacaatttacacgccaatattgaccagattttttctaatgtctggtgcccgttcgcggatagaagaaagcactggtttcattctttcacgcgacttgctagtgaaccgagttcagaagagtccatcagtgtagtgctttcacattttcttgaaaattatcatgtactggaaatggagggcctctatatgttaatcgataatgctgatgtggcaacagaccgtgatctatctcgtcagacactattattttttgagctaattcgccagcagttaaatccaaaagttcttgatggtattcagcagagaaactggcgtttcagacttggcgaagaagagctttatctactcgtattttcaaaccattatccaaagaaccattcccgctatatcccagtaaaaaacagtattgccttcttgatccaaccagaccgggttttcgataaattcgccaatgcagaaacgatgttgatcaaacaaaacgtcagacaacaaataagaaccatctattgtttacagggggtcgaatacaattattcgttatcagaatctaacgatcataaaagaaaatttgttaagtcaacggatttacaatcaataattaaatggtgggatttttgatgataccaataactgaaagtacaagtattgattttgacacaatatcttatccagattttttgggggttctgggagttgataatacgcctcctggtgggatgtttactcttgactactggatagaaaaatcaagaataaattcgaacacatatttactcgatttggcatgctcaacaggattttcggctcgtaatattgtgcataaaacaggatgtagtgccgaaggcatcgatatttctgcccgttcaatagagtctgctaatcaacttgccgttcagggcaatattgctgagtgtgttcacttttctgtagggaatgctgaatcggtctcatttactgataatactttcacgcatataactgcaggttgttgttttggattcatttctgataaaccagcggcgctcgtcgaagtccaacgggttttaaaacaggatggatttctctgtatttctccatttttttacgaatcagagcctgataatgaacttctttcattagttgaacaatatattggctatcgacccgatattaagagagattacagttattggttcaatttctttaatcagcactttactctattgcatgaagaattattcgatcttccagtttacagtgatgatgagatcgaaaaaaacgttaatatttctatctgtagcaaaccggtgtttaacatactgagtagagagaagcagcaacttgcttttgaccgttactataatacccggctgttgttgaacgagcatgcaaaatatcagtccgttgctttgtgggtgatgagagttaaaaaatgacactgtcgacgatagatttatttaatctcagtgaaaacgaagattatgtttatattctagatcttgacgcgatgactcagttcgttcgcgaatttagagggatatgggataaacaattccctcacgtaatttttgcctattcgtttaaaagtaataatattgcttccgtcacacaactgatgtttagagagggtttttctgctgaagttgtctctctgcatgaattaaagcttgcgattaatgatggattttttggaaccaatattttttttgatggcccggttaaattggataacgagattgagtttgcgctatcaaataacgttaatattcagtgtgataatataactgaaatagaaagagtattagcgcttgctgctaacactaatgctgaacctcacatttcattacgcctaagttccgactatcgtggccaaggactatcgcgcttcggtatggataaagacgagtggaatgaggccatcgctttactcactactcatggcattttgtgcaacgggattcatgtccattctggatctaatcttagttcatgccagggtattgttgacacgcttgagtcttttcaagatgaaataggtgctctcaaaaaccatcttcgtttcattgatatcggtggaggctaccctgcatcaacttgtggttctgatacagcatcaatccttgaacaatattcggtcaagatagctttacagctacggaggttaggaattgattttcacaagaccccccttatactggagcctggccgtgcattaacagaagattttggctatctagtgactagaatcgtttttgcaaaatgtcgttattccactaatgtgatcaccaccgcggtgcccggaacaaacataaggtctgctcagtatcacaaccatcgtaaggtattgattattccagaacgccctgttaattgtgaacacagcgttgcagatgtttacggttcaaactgctatgaaaacgatatcattgcaaaaaatgtaccggtcccgtttgacctttcactcgatgataaaatagctattttttcctgtggtgcttatgacatcatgaattctagtgactggattcggaaacgaccgccaataatcgtaatttcgaacggtaagacttactatgaacattaccgatttgccgggtgagtatcttaatgggaagaaaattcacctcttggttcctgaccttagtagaagtcaggaaatgcatcaattgattgtgaatttttcaaacttacaccgcgagtttctaacttgggctgatgataactccagtgaagaaactgtctttagcaatatgagtattgccagtaagaatttctctgaggatcgggatgagtataagtttctgattatcaacaaccatactaatcaacttgttggctgcattagcttgtttattcgtcatgctcagataccctattttgaaatagggtattggctgtctactcaagctatggggtatggatttattacagaggcctgcattctggttcgagacctggcctaccaccacttgaaatcaaaacgtttagaaatcaggatggcacgcagaaatattcgcagtagtaagctggctgaacgctgcggattctattgtgaagcaatattgaaaaataaccgaattgatggtttcggatgcttagatgatacctgtatctatatttattctaagtaaatctgtgtgattcatagtcatcatttcaattaactcttcccccgatcagtctgaatacgttgtattggaaacagcctctcctcagtaacacaatcgataaaatccagcgtatttgacgctgtacggcggtgatagagccttagaactctgtagcgggtgcaatcatctgctgaggtgtactggtataaacctagagcaattttgcaggtacagttgtagtaactggcttcagatacgccgttctcgcgacagacatctttcacatgccggccaccttcaacttcttttagaacccgcaggatctgagtttcagtaaaacgtgctttcttcataatgacccccgctgattatatattaaccagagaactccattaaacgataagactaaattcaggggggactacacagtgaccgatgccggcgccaggaataggggatagccaaagcaaaagcagcagggaaatttcggggacggcaggcagaccgagaacggcatgaacggatcatcgcactgcgagtcaataatcgacagagtattcgtgagacggcaaggttatgtggagtttctgaccgtacagtcatacgtatagtcaaaaatgcaaaaatagaagctgaaagcaactaaattaaatacggtaagtgtcaaggtagttgtcaccccaggttgatttatgcggcctgttttccccgctctggatttaatgtcacgctttcctgccattcccagtttcgcgtctgtcgtgaccaacgtttggggttcgcggctctcgccgcttgatagaccttatctcgttgggccaacagcgccttgtcctcacccgtatgtcgctgcaacggcgtcacataacctatgccactgtgccggtgctcttcgttataccaacgggtaaatttatccacccagacccgcgcttcctcaagatggttaaagcctgaggatggccactgaggcacatatttcagcgtgcggaacaacgactccacatacgcattatcattgctcacacgcggtcggctgtgtgaaggcgagatattcagttctgccagcttcacctgcagggtctgcgacttcatcgccgcaccattatccgcatgcagcaccagtggctggcgataacagcgctcccgcagtaccgtacgttgcatcagcgccgccgccaactcaccactctcggtttcatgaacttctgctccggtgattttacggctgaacacatcctccatcaggtacagataataccaacgaccccgtacccatgaaggcagccacgtgatgtcccacgtccacacctgacaaggcccggaggcggtgaacgttgttggcggttttacccggcccggcttgaggcaacggccacggtgatgtacttctccatgacggcgcagcacccgataaaaggtcgattcactcgccagataaacccctttatccgccaaccgtggcacgatttgcgacggcggcaggttggcatactcgggttgatggcagaccgcccgtatctgctgctcttcttccactctcaggcgattggtgggctccgggcgtatcgccgtagttctttggtcttccggggaggtttgccaccgttgccaggtccgtacgctgagctcaacttcgcgacaggccaccgcccggcgtgcaccagcagcgacggcctcatttatccacgcgataaactgctggcgttcctcgctcgatgtcagtcgtcctcgtccgtttccccgtagtagtccctgagcttttttcttaacaccaggatcgctgccgcctctgccagcgccttttctttgcgcagcagctcctttttcagttgcttgttttctttcttgctttgcttgagggccaccttatcgtcacccgagggggacctgcaaaaaagcctgtttccattgcgctatctgcgcggggtaaagcccttttttacggcagtattcggcgatttccgtttcacttaacgtggcggtttccacgataaccgcgagccgcgcttcggcgggccactgttcactgtttttctctgcaccgggcaccggttccccctctgatttagcctgattacgccaattgtagagggtcgcttcggatattccttccatctgtgcaactgccgcgacggtcatattgtacgggggtaataattttgccatcacgctggctttacgttctggagaaatacgtttcatttgtcactccatcgccctctggatccatttttagacgggggtgacaactatgctgacactgagggcagggtggcgtcagcatcatcggaagtacagaccatgccgataatggcggtggaaacagtggaaataacgcgagtaccgtcgttgatttcgatgacgcgcgtgccgtgatgataatcactcatggattaactctctgttggttgagggtagagagtatggtggcgattgatgagggttgggtggcgaatggcacaacgagaaaactataaaatgggtaaccactttacgcgatatagagtggttaccattaacaggaaagtgatttttctatcccgcgtgtgacgtcttttttcgtgctctgaacttatgaaatcccttcataataagcacataagctagcgatgcgacaataatatcgagaaccagcattgccgggaaatagatatcttcggggttactgaaccccaaaaactctgagatactgaaccagtactgtaactggctctcaggcatcggataggggtaactatggatatacttaaccgccagtataaacaggccgataaaaaatagtaccttcaataacctacggacaagtgttgccattcgtcaccacctcaatacacccataggccatcaatttagttccattaactgcaatggtttgtgtgtggagtagggctttgcgcagcacctgaaaatcggcagcatgttgtaacgtgatacaccccatagaaacccccatcgggccgatgggatgcaatctgaaatttccacgttcaacattattgatccaagtgtaatcgtcaattttcccatcatcacggtacaagccaaaccattcattatggtcagtcggcgcatgggtaaacttggtggggaaatctttcattgcggtattaatgcgggttttaaccccgcctttagggcgctcaacaatccagtagcacccctcgggtaatggccgttatcagggaccatggtacagccgcctctgttgcggtatgccttattgccagaaaaggccataaatgtaccaacaccaaaaatactcaaaggggagtagtgagcattgttaacaacaaactttccttgtaatgccatagtgtcctcatatttttatttaatactgtcttgcgtctattgcattgtaaagcaaatcacttatccaagtaagtaacgaaacaaccaaaacataacttatcgtttccttaagatatatatatcgcgcatgaggaatactttattcgttcagtttggtttgttgaacggctatattttattttttccacaccacagaataattgagatatttcttgatattacttaacacgtattttcggatgtttctcttttaatctctttagcgccaatcagtatttcgaaatatttgaatccgtataactacataaactgaataaacccacgctaaaaataatcaaatagaaaagaggagtgcgattcacctgaacgcacccattatgcctctaaccgttacggccagttgggaatacaatacccctgattcattgcctcgatcaaaagccattgcggcagttccggcaattcaacctgcggccagttttccaccgtggcgatgtttgaaacatcacatcggcttgtattgtgtcattcccctgagtggccgcgaacgccattagacacgtaacaggaaaggcggtggggaaagccagttcagggtaagcgatattttcgctggcagaaacagggccagtcatccattgcacaatcagcccgcccggcacgtctggaatacggatataatccgagccagcaaagtgacgtttaccaaacagcggcagcacacccgcgattttattgttaataaatccccaaaaatttccaccccctacaccgccccggtgatatctccactgccagcgtaacgcgcggctcccaacgcatcacagcgccataaacagcggccatcatttttatacgtaaggcgggattttgcggctggtcgatcaaggttgataacagtgagccataatcgcggcgcatcacccgtgtgccttgtggtgtggccagaatgtcactgattgactggcgaatatgatcaatatcgtcgatgttcaagccgctgttgcggttcatgccgctatatttatcgctggtcatttaaccccctcagtccaatcgccaccacgctgcacgccgccgatactgatcaccatgacttgcttacccagcgatggcgcagaccaaaaacgcacccgcccggcgcgcagggttaaccaattaagccaatcggtttccaggttgcccattttgacccggcataatccgttagcaagatcgacgtctgagacgatgccaatacggataatgttagccaacaggcgtttaaggccagcaataaggatattcatgcggccagtgtgccgcctacgggcgcgcgcggcatgtgatgggttttgtgtgagggatggcacaaaggaaatgaaataaagtatgaatgctaatatctcttgcattaatgtatttattgggggtacattaatttcatggacatatcttacgacccaatcaaaaacgaaaaaaatattgctgaacgtaaactgtcctttgagatggcgcgtgatttcgaagttgctacagcgctaattgttgaggatctccgtaaggaatatccagagcggcgcttccaggcactgggctacattgaagagcggttacatatgttggtattcacaccacgtaacggcaaggtgcatgttatcagcctgcgtaaggccaattcccgtgaggtaaagcgatatgaacaaaagaatcagtaaagtcaccatgacagataaccccgagtggggcgaggcagagtttgcccgcgcacgtcctgccacagaggtgtttaccgagttgtttggtaaagagggcgcagaaaaggtgataaaaacccgtggccggccaaaactggcaaacccgaaagaaccggttaagctacggattgatcacgatgtggtggacgcctatcgggcgcagggtgatggatggcaaaccaaaatgaatgaggcactgcgcgattatgctaaaacacatgggatgctgtgatttattaggcgttattttcaataaccaatcaaagctcactcaaagaagccactaagagggacattatggcaagctgcatccccccaaaggttcccggatacttacaaagaattcgggaacaatataaggaaagtgaacctgttatttataaagttcttagccatgcaaaagtatttgttcgcgaagattaccatacagatcataattatgatgctgttggtcatgatatctgtcttttcttgccaatggagatattgatagatatacatatttctaaacaggaagcatatacaaatttaattaaaaacgacctcaatattttgacaagatctgtgcatgatgaatggataggtgaagttgcattagaactgaattctgagatagatcctgaatatcaacaagctatcagtatcaatgaaatagtcaacgaggtgctgaatcctgatgagttatccatctggaagccaaatttaattcgagtttttattagccatagagacaaatataagcgtgaagcacaagaattagctaactccttagaggagtacggcttcagttgttttgttgcccatgagactatcgaaccactcaaagagtggagaaatgagatcgttaacgggctgaaaacaatggaagtgatgctggttttactaacggatgatttcaatgacagtatctggacgtgccaagaggttggctatgctctcggtgcaaataaaccagttgtaaccctaaaagttggcaaggtcgatcccgctggttttatcagtcatttacaagcggttaaagggagcctcgataatcctacgcataatgccgagttgttaaatatgctcttagctgaaagcattggtaaagcatcaagaatacaacaagcactaatttctacatttatagcatctcagagttttgatgaagccaaacatcgattcaatcgtatgaataagagcatcaaaaaacttacggaagaaaatttaaataccgtaatggatggatttcgaagaaataatcagttgaatcagtgcatgtatctaaataataactacaacagacttaaaacttttattgaacggacaacaggaaaaagcgcaataacgagtgggaaggaaatatttatcgagactgtaaacaagattgtgtaattgcctgtttttgatatcttcactccaacaacggagacaggcaaattatggacgaaaagaaacttaaagcacttgcggctgaactggctaaaggtcttaaaaccgaagccgaccttaatgtattttctcgtatgctgacaaagcttaccgtcgaaacagcgttaaatgccgagcttaccgaacacctcgggcacgagaaaaatacccccaaaacaggctcaaatactcgcaatggttactcgtctaaaacgttgctgtgcgacgatggcgagattgaactcagcacgccccgtgacagtgaaaacaccttcgagcctaagctaataaagaaaaaccagacgcgcatcacgcagatggacagccagattttatccctgtacgccaaaggcatgaccacgcgggaaatcgtcgccaccttcaaggagatgtacgacgctgacgtgtcgcccacattgatatctaaagtcaccgatgcggtcaaagagcaggtcactgagtggcaaaatcgccctctggatgcgctgtaccccattgtttatcttgattgcattgtggtaaaagttcgtcacaacggcagtgtaattaacaaagccgtgttcctcgcgttgggcattaataccgaaggccaaaaggagctattgggcatgtggctggccgaaaacgaaggcgcgaaattctggctaagtgtgctgacagagcttaaaaaccggggtctgcaggatatcctgattgcttgtgtggacggtctgaaaggcttcccggatgcgataaacagcgtttatccgcagacgcatatccagctctgcatcatccatatggtacgcaacagcctgaaatatgtgtcatggaaggactataaagccgtcaccagcggtttgaaaatggtgtatcaggctccgacacgctgatggtgctggataagtttgcggaggcctgggacgacaaatacccaaaaattagcaaaatttggcgtacgcactgggaaaatctcaatacattcttcggctatccgcccgatatccgcaaggccatctacaccacgaatgccattgagtcactgaacagtgtgatccggcaggcgataaagaaacgcaaagtattcccaacggacgactcggtgcggaaggttatttatctggctatccgggatgtttcgaaaaaatggagtatgccaatacagaactggcggttggcaatgagttgttttattatcgagtttggtgaccgcctgagcgatcacctttaatacagtggcggttacacagaattatggacagactcggctgaggctgtgtgaaatttttaaatatatttattaggcatcattttacatgatacgaaaaatacaatcactattgttaccagtgttagcttaccaaagtgattagggaaaaactctaaataacacattgaaaataaagcaataacaataaatggaattgttgaaaataacacattgtataatattcctttcattatctttccttgtcatttaatttgcttaaattttttatcagccatttgcgatttaaatacaatagatagctctgattgagttactaatcagagctactgagtacctgtttgactgcctgccaaacctgataagccgaatactcaatgtttagtactgttgagactgtaatcttccggcacccataaactatggatagaactctcgtaacatcgtctctttgcttaaggtgaatattaacaagtcactttccttaaataccccctctttaatcaagcgattttttaaaggttcgaatcgtttatcattagcgaaaaaaagtgcagtcaagtaatcagagtcaatcgattgttgttgttctgagaggtgaataacctgcctgtagcattcatcatctcttttccctaatctttcttttaccatgcactcagtcaataagtcagttcgggtgaaatgctttttgttgagtatctcaagttcttgtagcccttctgcatagtatctatcagcaagtaggctatttatgtacatttttctgacattaatattttctgggttttcatctaacagatttttaaactgtttgaaaatttcacttttttcactatcttcagatgttattaatttctgcacaagtagagccgcttcctgcgtgggattatctgcaggcagactctcattaaaaataggaagagaaaaaacaggtatacacaggaataaataaaatattgctacagataatttaactgattttttcataataaattatcctaaaatttatttaatgtgatttgtctggtcaaactgccagggaatggcctgattattctggtatatcctgtatgtaaaaaatacccagcttctatatctaagacggggagtatgtttttcttacaagatattaaaaatgaactgctgccgataagaacttcatcatgacggagaataaaagattccccgttactctctaaaacatattttttattatctatattattttttattttacaccaaggaacaattttaccggaaccataagccttagcagcattacagaccagcgatgctgataaatacattctttttccttctttaacattatcttcagttacattaatagataatgagaaagaggcgtgtacagcaccaacaccttcagctcgcatgtcggcccatcgagaaaaatagaatgattttgtcgacatttttattcctttttaatctttcagtaatgcccgagtagggcatataaattatacagccagcgattatggcacccaatttttactgcatcctcaaccggcgtaatctttttctctatgcaaaacttcagatcaacagatctttagaagggaatgtacattaatgattattggagtacgaattagttttaacaataagttagagaaaacaaaataatctgaaaaatcacacaattattgggaaaattccttaagttccattctggagaatgtcggttctttcggtgtaatcctgctaatttactgtatcactcggatcaaggtagccactataccatcaggaatttcagacagttactgtgacgctatcagataaaacaaagcctgagtcgccgggggaattgctgggataatagtccaatggagcgattttttagaggtctgaaaacggagtggatgccagataatgggtacgataattttagcggaaccagcacagccataacgaattacatcacgggatattacaaccagcttagacctcatcaatataatggtggtttgacactgaatgagtcagaacgattgttctggaaaaactctaaatccgtggccagtttttgttaaccattacatagagaccttctgacataatgattatatcccctgaggaggtctccatgcgtaagatccgatttaacgagcacgagatcattgccgttcttaaatttgtagaagccggacgtaccgtaaaatatgtgtgccgtcagtccgctatcttttaagccaactattacaattggaaattcaaatatagcggtatagaagccattgatatcaaaaaataaaagatcttgagggcgacaaccgacggctcaaaccaattgctgaccataccagataataccagttgcacggaaagggtatcatcaacgctatgccagatagataacatcaggtaatctccctacatgccgggtggaatgggtggaaagggtgtggacagaaaattcatcgagacactgaaaacatactgtgatgatgctaaccggggaggggggccgctctaccagcgtctggagaaaggtttccgcgatctgatcacccgtggtgagctaaaagccggatacgcgattcccagcgaacgcgaactttcggaacgcttgaatctgtccagagtgacagtccggcgtgcgttaagtgaactggctaacgcgcaggttatcgtgcagcgtcgtggagcgagaagtactgtggcgggaagggttgaaaagccgctgtcttcgctgaccagctttagtgaggatatgatttcacgtggctatgagccaggcgcacgctggctacagaaagagcttactcacgcttctccctcggaaattattgcactgaatctgtctccaggtgctctggtgtggcgtctcaagcgcctgcgtaccgtagatgaacacccgatggcagtggaaatcgccgtggtgccgcagatgtttattccagagatggatgaactgagggattcgctttattcagtactgcagttgcacgggtttatgcccgcccgcgcgttacagcgtattcgagcagaaccgctgagtcgcgatcacagccaactgttagatatgcctgctcacagcccggcgctgcatgttgagcgccattgctatctggaagatggccgcccgattgaatacacccatacctggtatcggggcgacagttacgattttctggttgaacttcagcgcgacatcacccccggtctgtcatgaacccgtcttactgatgctgagctcctttggcaacactcagtcatcctgtatgtaccaccacccaacatcggggtaactggcaggttgaatcgcgcaggaaacgcttgaagtgactttcgtaccctgtccaacatgccatcagtaagaccaacgctttcattaaccaccacttcctcgatatctaagaccatccgtatatccgcaatcgcctgagtgacagctccggctggcttagtgctatgtgccatcgccatcgccatccattaacccgatcatcatcgcttggtaaggcgcaataagctgatttttaaatctattttgtatcaatcatcctcttttcattcctcctgattttgccatggtcaaacagacaaccacagtaataccagatgggtgaattggtattattaaagcgaaccttacgcaccgtgatggtgctttgagtttgctcaagagcaccatcattgttctgtaaacgagaaaaatccaagcactgcaacccgtcaactatgttgcaataatgttgcaatgaatgttaatggtgttgattttaaattggtttttattttggtattaatctggactcattttggcatggtaattgaattactgaatatggacggggaacgttacacagtttttcaaactagttaccgaggaaagtgaaatgacagatcgtgttattaaagttggcgttattggcgcgggttttatgggggcgatgcatgcccgaatttggcagcaaatgtacggtgtcgaagtggtcggtgtggccgatccagatttatcccgcagtgaagcgctgaagccgtggatccctcaactgaatggctatgaagatttcaaccagatgctggagcaggaaaaaccagatattgtcagcatctgtaccaaagatgacttccaccttgcgcccgcacttgcagctgcaaaagtgggtgcccacattttcctcgagaaaccgattgcggctacggtggaagacggtgaagccatcacgcgtgctgcccgcgaagcaaacgtcaagttgggtattggtttcctgctgcgtttcgacccgcgctactcacgtgcacaagagatcctggcttcgggcagtgcaggcgaagtgagccatattagtgctcgtcgtaatagtccggctatcgaaggtcctgcccgttatggcggtagcctgccgttgccgctgcacgtcactgtgcatgacgttgatatgatcctgtggttgctaaagcatacccacccgatcagcgtctacgcccagaccactaacaagcttctcggccatctggggacggaagattctgtctttgccatcattcgctttgccgacggcaccgttgtgaatctggagagctcttgggcgctgccagccggttcacgcacgttgctcgacgctaaaatgtcgatcctggcaactaaaggcctgattgaaattgaatgcggtgaatccggtctgtatcacgcgtctgaaaacatgaaccgttacatcgacacccagcactggccgctgagtcagggtgaactcaaaggcgatctgcgtgaagagctgatggcgttcctcggcgatgttcgcaccggcactacccgtgtagcaaccggcgaagaaggcaatgaggcactgcgaattactgttgccattatggactctgcccgtaccggcgaaattgtccgggtctgacattctgactgaataaaccaggtgatgagatgagcataaaaaaaataggtatcgcaggtattatcggcacgttgctgatggcgggtaacgccagcgcacaggaaaccctccgtgtactgctcgaagggcacagcaccagcgactcgataaaagcactgttacccgaattcgaaaagcagaccggtattaaggttcaggcagagatagtaccttacagcgatctgacctctaaagccctgctggccttctcctcgcacagtggacgttacgacgtggttatggatgactgggtgcatgcggtaggttacgcctctgctggttatatcacacctgtagatcagtggatggagagtgataccgccttctacgatggtgcggatttcgtcaaaagctatgttgatacgctgcgttataaagacggttattacgggctgccagtctatggtgaaagtaccttcctgatgtaccgcaaagacctgtttgaacagtacggtatcgccgtgccgaaaacctttgatgagctgaccgctgcggcaaaaactatcaaagagaagaccgaaggtaaggtggcgggtattacgctccgtggagctcaggggatccagaacacctttgcatgggcgtcattcctctggggttacggcggccagtggattgacgacaacggaaaatctgcaattgcttcgccacaggcggtagaagccaccaagtcattcgtcaatatcctgaaaaactacgggccgatcggcgcggctaacttcggctggcaggaaaaccgcttggtattccagcagggcaaagcggcaatgactatcgattcgacagtgaacgggggcttcaacgaagacccgaaagagtccacggtcgtcggtaaagtgggctatgccccggtaccggtacagccaggcgatcatccgggtaacagcggcgcacttcaggtgcatggcttgtatatctccagcgacagtaagaagcaggatgctgcctggaaatttatcagttgggcaacggacaaacagacgcagatgaagtcggtcgaactgaatcctaacgccggtgtgagttcactcagtgccatcaacagtgatgccttcaccaagcgttacggggcctttaaggacggtatgctcgcagcattgcaaaacggcaatgcgaaatacctcccaaccattccgcagtctacacagattatcaacataaccggtattgctctatccgaggcactggcaggtactcagacagtagaaaatgcccttcagcaagccaacacccgtaatgataaagcgttgtcccgttaatcgctttccgtcagtgcagttgcgcactgacggaaatgaaattcttacgcaggtttaggtaaaactatgaatgcaaaactcacgcagcaggcgtttactctgccgttactggttgtgttgctactggtttcgttctacacgctgggttacgccatctatctgtcagtccacgacatcgatctgatgtcgcctccgccatttgatttcatcggcatggcgaactttattgaggtgttacaagagccacggatgtggtcatccctttggaacacactggtttatgtggcgggttcaacggtagcagagttggtgcttggcagtgcgattgcgttgtttataagccgtgacttttttggccgtaagctggtacgtgcgctgttactgctgccaatgattgtcacaccgattgttgctgggcttatctggcgtattttttacgatccaaacgccggtttatttaactggctggccggcctgatcggtattccgccgattgactggttaggtaaccccagcaccgcgatggcttcgttgatcctggccgatatctggcagtggacgccgtttatcattttactggtttcagccggtctggatgcgttacccagtgaaccgctagaggcggccgagctggatggcgcgcgcggttggcggctactggcctttattaagctaccaatgatgaaacccatcattctgatggcgttgttcctgcggatgatcgacgccttcaaatccttcgacctgatctacgtgatgacccgaggtggcccggcgttggcaacggaaaccaccaacatgtacgcctatcttaccgggtttcaggatttccgtatcagcgcggcggtggtgattgccatcatcaatacgctactggtgatcgcggtactgtcatttgccagtaaaaaggtgatgaaagatgagtgattctttgaagtttatctgccagagaacgggcttctatctcctgttggtggtgatcttggtgttttttctgctgccgatttactggttggtgacgatgtcatttaaaacctatatcgacgcgtttgccatgccacccaagctgtggtttacgcccatcttggataattaccggcaggtgctgggcaacggtgactttattcgtgcatttggtaatagcctgctgatatcgctggtctcgacatttctgtgtttgattctcggtgcgttgttcgcatacggcctggtgttcttcatcgaacggaaagggcgggcgaagcagttcattatgagcctgcgttatgcgccagtgatcatgttggtgatcccggtttactacctaatcaccaagctgggaatgacggacaactatctggtgctgatcctggtgtataccgtggcaaacgtgcctttcaccattctaatggtcaccactttttttgaagatattccaccggaaatccgggaggctgcccgcgttgatggggccagtgagtggcgcgtgttcttaagcgtaatgttaccactggcccgcaccgggctggctgcgtcaggcgtgctgacactgttctttatctggaacgaattccagattgttctaacgctctctggtgattccacacaaacgttgccagtggcgatcacctcattcctgacctttcaggggacagagtggggcccactgacggcagcaggaaccttggtgatgttgccgatgttggttctcggcctactggtacaaaaacatctggtgcgcggtttaaccatgggcggcgttaagtagctcagaaggaaggaggagtaaattatgtcaggtatacgtctgagcaatgtgtttaaacgctttcatgacacacaagttattaatcaggtcgatcttgaaatcaaaaacggtgaattttgtgtgtttattgggccatcgggttgtggcaaatcaacgttgctgcgcatgattgccggactggaaacgatatcttccggcgagatctcaatcggcgataaggtggtgaacaaactggcccccgctgaccgtggtgtggcgatggtgtttcagagctatgcgctttatccgcatatgaccatttatgacaacatggcgtttaatctgaagctggctaaaaccgaaccggctgagatagagcgccgtgttctgaacgctgcaaagattctgcaactggagctgttgttacagcgtttgccgaaggcgctgtctggtggtcagcgtcagcgcgtggctatcgggcgggcgattgtacgtaaccccgatgtgttcctgtttgatgaaccgttgtccaaccttgatgcttcactgcgcgtcgcgacacgtgttgaaatcgccaagctgcatcatcagttgggtaacaccatggtctatgtgacacatgatcaggtagaagcgatgacattagcggataaaattgtactgctgaacagtggtgcagcgatgctgaatgaaggctcaatcgcacagactggccatccgctggaactgtatcaccatccggtgaatgagtttgttgctggttttattgggtcgccgaaaatgaattttctgtctggcgaattggtagcaggaaatgcgcaatgcgcgagtattcgtctggggggcgtgcgggaaatcgaggttcaggtggataccgccgccgctcgttcaggtgagcacgttaaagtggggatccgcccggagcatctgcggctctgcgaccaagcagaggcacacttaatcggtcaaattcagcatattgaacatctaggcgaagctgcttatttctatgtttcggtaaacaattttgatccgatgttggtacggcattcagaagatcaggaactggcgttgggtgatgacgtagggcttatgataccggcgcaccatgctcacctgtttgacaacaaaggcgttgctttccgccgcactgcatcggcagtgcagaagccgttttcaaccgcgtgaaaagttaggtcattttttatctttacaatctgctagcctcaactgcacgctgttacgtccttggtgactcatctggcgctcaacctttgagaaatcaaggacgtgaaccgccaggttggcgagcagagacaaaccgtgggaatcggttaatttaaagaatttatcaaaaagtttactgcaagggggaggtcaatatctttcccgatgcgagggaataccgaataggcatcgggaaggtttttcacgctatcttattgaatctagttaatagagagattcgcaaaaatgcctgaaaataagaatttggctcctctgactggactcgaaccagtgacatacggattaacagtccgccgttctaccgactgaactacagaggaatcgtgtgaacgaggcgaataatagcggggggcggggtgtttgtcaaagtagaaaaacacttaataggttcgtttgctgagagagtgagcttattggcttgtttttcagcaaaatgattgattttatttgcagttgcctcagaaactatgcggttttgagggggacgtgatcggatggctgccgtttatcagtgaacgaatagatacgttcatatttgttggggcgagtggcgaggattagggtaaggcagtactgtcgttattgaatacataacggggaaagggcgaaaaataaaaatctgttatagcgttaccgtcactgactggctgtttttaacttggttacccgcatcatcaaaataaatataactgacggtaaacttgcctttaagtgaggtgggaggctgttcaaaataatagggtcgtgtggagaatgggccggtcatcatatccatcgactgtgcaatcaggtagtttttttgttggctctgtaactgaatctggccaaaagagacaaaataaggcgtgggattattcgcgattataacgtattgattatcaatatttttaagtgaaaactttatcttacccatggcatcgatggggggcggggctaatccgtttggtcgataaaaaatcttcatttgtgtattcattgccatggcaacttgtgcatgaacatcaatgttactccgttctctgggcggtatttcatacaaattcaaccaatagacagactcccggtcactgggaaggttttcgcctttattgatgatgcgtagtgcctgaaccgatcctgcctgcattttaaacacggcaggcaataccataaaaggggccttagcctgatccggcgtactgtccacatcgccgttatcaatccatgtctgcacgacgacgggataatcattagtattagccagcataagcgtgcgctcacgtaactcaggctgataaataatgcgggtagatccggcgatcaaaccggccagtgcatcgtagctgatcgtgaataacagtaaaaacaggctcagtaatctcattgtattttcaccagaacgtaagctgtggcgtcgatcttccccgcagtagggtgaccattaggcagtttttttaaggtggcggtgaagtgatggacataattgttgtaacctgcagagtggctgccattaccactggccccagtgagtatcgggtaccagcccgcatcggcggtagttagacagtcctgagtctgtgcacatcctccccaaccaacaaaattcatggtactgccattgctatcgcttaggctgatacccacgccagtggcgatacggctatcagtaccgtaactgtctgagagcaagtaactcactcctcctgccgtattcaccaatcctaatcccagcgctttaaggtagcccggtaatgaggtttggatcccaatggcggtttggccactggatgtccctgattcggtacctgactgacactcgatatctactgtgatttcagcactgcgtgtttggttatcattaagttcattcactgtaatgatcgggaaaactacataaggcgtcacattgcgtactacacaggtatttttacgcgtcaggatagtgatgggggatgtgttcatgccaaatgccatatagcggcccgttccccaagtttggtaattcgtcgctgaatcatatcctgcttctggcaccgccatgccgggtcctttgaataccacataaccattaggttgattacaggtatagccgcctgagtagttgtcctccgccggtccagggcaaccccaactggtcgggccgggtgagcgatctactgagcctgtttttttcaactctgcgcggatctggctgaagtgtttaccttttatctggattttattgtcaaggatatcgtacttttttaatgggatttcttgccagatacgggtgaattcaacacctgaatcgacatgaatcagtttcagcgcggtataagggaaaaacgtttgaaaatagttatcacccatatgggtgtagccgccaacattgctgtcaccattggtagcaaacacttcaaataagctgtctttatcggcgatgtcacattcatagataacggcttctggatctggccaccgatgggcgggcactaagctgatgacgttagaggccaaaattgaatcgacgggttgaatataattactggtgatattgatattgcctaaatacagtgaggcaccgtagttatccccgccaatatcactccctttccagacacattgtgcctgactgggtaaggtaaaaccgagcaggcacagtgaagataacacgctcattaaacggcagaatactggcctattctggttgaatcggtaacgagtggtatttcgcgtgataataggatgcatgcggttttctctgatttattgctgtaccgcgacacacaaggcatcgagtttatacagctgtttatcgttatccgtcggcttacccagatcgtaatctaactgacagcgttctttgctactctctccccacaccaatgtgagggtaccactgagctcctccgcccgtagataggcttggctcgactgcccgaccatacccacgatgtcattcttatcgttagtgcccttgccgttgtaattataaacgacggttcccataggcaattggctgccatcgggcattttaatggtgattaatgcgggataaccgttgagggtccggaacgtcactttcaccgtagagccagcataaggcgcaatctgtcgctctccatcctgcaactcagtattgaaatccataccatcgggatcgagagagagtgtgttgtagcgatacggtgtcaatgtcgggaccaatgcatagccgaagcggtcaatacgggccccttgcccatacattactttggcaccactggcacccttcgcttctatcagggcgaaagtgtcgcttaggtaagggccaagcgtcacgccgccacggtggaatgcgaccgatccacgggcgctggcagaaccttgccagtaaccggggctgcgtgaggcactgccactcaaactggtggtcgggagctgtttttgcaaactgccgcttaaggtattttcgttggttggctcgttacgggcaacatccacactgtagcctgcggtttggtcactgcccatggttcccgaaagtgaggtttgatagctggctccgctagttctgctgtttactgcgccagccgagacataaggtgcagacgagctaccccctagtgggaaggaaattgacatttgggccacagtttcacgggtggctagtgtgttcgcaccatttgaggctggcatgccactgcctgggtcaacgaagtaaattttatttgcgcctccggttttctgctgtgaaatcgccagattgaaactggtattacgccagaaggtgttggaataacccagttgtaactgtgaatcccttgaacgatcatctcgataatcttgtgaggaggcagttaaatataatgaaccatagcggtgaaaattttggttgagggatatttcagcccggctccgttgccgataagtactggaattccagctactgtcattgctggtcgcccgcacgcccagtacatcgcttaaatcacggtaaccgtcagttgaatagcggtaacctgccacggataacgtggtattcgtgggttgaaaggtacggctaaaagaggcttttgccatccagccttgctgctgttccccatcgggtaaacgggcatgggaataggttgtattcagacctaacgcaccaatatagtgggtaaacacaccgcccagcatgatagcctgataacccgaagccagccggatccctgtgttagctgtgatggcattactgataccctgttggtaggtcaactcgctgaacgtctcgttattgccaacatcgcgaacctgcccggccgcaaagctataacgtgaatagccggggcgtagggattccgggacagaggcgaatggcacctgaaaggtgcttacactgccatcagcttcattgatttcaaccgtcaggtcacccccaaaatgggtgaccgataaatcattaaattcaaatgcgcctggtgataccgtggtttgataaatcgaacggttgttttgataaaccgtcactcgcgcgttggttctggcaataccacggacaaccggtgcatagccccgttgcgattcgggtaacatgcgatcatccgttgacagcgcgacaccgagaaaaccaagactggagaaaaactggccggaactgaaggtttcacccagcgtaatttcactgccgatagtcggcagggcgcgctgactgtacagacgattagatgtccagttagtccctcggctagcgtcataacgtagggatccttgctgacgaaaacgccacatgccgatattgataccgctgttcagactcagataagtagagtttgtggtgcgcttaatcccctctttgttgtaatccacgtgatattgattcaagttgtaattactgaaaccaatcgtattgcctgcagtgagatttttcgggtcaacatagccacggggcacgtttttaacaaatttctgagggatggacagatcaaaacgcaatttagcgtgatcaaatcgaaagtcactggccggaagtatggattggaaggccaaacatggcgttttaggatctgctgttttcagggcctcttcttttacacccgcttgtaataattgcgcaacagacagacaaggttcaacactattatctttatcaacaaacagcatttttaggcgatcaacaaatttgttgttcatatacatatcaacttgatactggcccgcgtcgtaactgttttttttattaaaacgggcaatcgatcctaaaccgagtgatgaaccgcgcactaacgcatcatcaaatatatagtcgtcttgattgttattatccgccgctgacgaaatatgggtgaccagcaagctttgtgtcagcaagcatgagagccaaggagcgattctcaccagtgttcccagtgtctggtgatagattggattaacatcaggagcagattacagataataattattaggaatggtggcaccgtaatcattaactacgttcagtatcagtaattcccctttcttggctttaatcccaatgggcagggccaaatcagtggtagagtcgggcgcgaacatttcactagtggcaaacgaaacggttttgccgttactgacaattttagcatcgcgcaggctgatgtaataacctgttgggttatgtactttaattttgttacctgtcgttgtatctagggtgacgcttattttttcacctagcgtatcgatattttcctttaacgctgcagggcggaaaaagacttttagtcggttattgacgatcaaaaccaacttattatccggctgcgtatcggcttttaatgcggggatttgtaaaaagttaagataaaaaaccgattcacgatttttgggtaaattacgcgcaatgtaagtcaaacggacaacttgcccactgttggcttccatccggaatatttgtggtgtcagtgcgaaaggaacatcacttttcgagggtgaagattgattatttccatcatccatccacagttggactaaattaggatggtcatctttattactcagctgtaatactttttcccgcgagccttcaggataaatgatacgcgtccctgtcatgacaacactggcttgtaccgataaggatacgctggtgagcagcaacatcgagcaggcgataatttggcgggcaatcaagatcatgttacttacttatccttgttttctctggtccattaaggccccgttaccggttggccgacatattcatgaaaatgctcagttgccatgaacggttaggggtaggtgatcgcatactgtgcagaggcaataacactgcctgcggttgcctggccttcttccgttatatattgtgccgacagatcctgtgatgctgaggttgcgccagtcgccaaggtaattcccggaacttccacactgccaccagacatacgaatcggggtgccacggggatcaattaattgaatggcaacatttcttgctgtgccaatattgcccaggtttccgccagacgtgacattcatcccctgaaaaacagagctgatttgggtatcttgaatcgcaatattgcagcctgttagattgatcgtaaagttggtctttcccgccaccgagttgacttgattaaggttactggtcgagacagtcggcagcagaaccaccggggtgttggcggtaccattgatatccaccatacaggtctgttctgcgacttctccctggaactttatggtattgttcgaggtttccgcaaaagctatacccggcaggataaatagcatcaacgtcactaaagtttttttcatgttattcccgcttaatatggatgtgtattttgataacaacgctattcagcaaaatgaatattcattgagaggaataacatgggccattatctgtatattgctgattttgtttctgaccggaaccagtctagggggaaatagtgcagagtagaatgagagacgtccttgttttatctgtgaaatttcctacaagccctgtaggaacctatcctggtaaaaaatagcataattaaaaatgtattctatttcatataattaaacgcctttgagtgtttgatgggatgaattagctttttatataggcggttatcctcatcgctgaatcaaaaaaaaacgccaagaagactggcgcttttaataggggaattacgctataacctttattgtggcgagtcttcagtagcggctttaggatattgagaaattaatgtgactaataactgattagattcaataaacaatgccagacaatcagcgccatgtgtcatcgctgcttgtttattctgtgcatgtaattgagattcaaatttcacgcaacttgcgaccagttcttgagcatcaatcagttgtacgctgcctttaatgcggtgtaccaggcttgccatctgtttataaatatctgcgtgagggatgtggtcactgcctgtcgtgctatgacgacctaccgtgctacccggtcctctggtctccccatcttccacagtatccgcagtttccgcagtatctacagtttccgcagtatctacagtttccacaacgtcttcgtcttctacacagagttggcgataaagttgcgtcaatgtgacagcatcctgcaaattgctttccagcaatgattgcaataattgcaattctaccgcagggttcccccccgataatgtccgcagcttattctgtgccgcagctagcctattaaccgaagaggtgatggttgtgctgtggatagctggagcattttcttgctgggctgtatctttttcactcaaattgtgttgattgccaccgcggtcattatcttctgtgctgtggctatgattggtattcgcaatctggctcacgatatctttgcgcagtaaggtcgcctgtaaagtatcgatggccacgggtttgatcatgcaggcattcattcccgcatcaatgcagcgtgctgcactttcttcgcgggcgtcagcagtacacccaatcacgatgaggtcttttaaggctggatcctggcgaatatgtgctgcgagttcatatccatccatcaccggcatactgcaatcggttattaccacatcaaagttattgtgctgcaatatttggcaggctttcgccccattttcggcggtgactacctgctcgataccaataaaggccaactgttgttgaagtaactggcggtttgcgggtaaatcatcaacgaccagaattcgcaggtttctcagttgattcagccgttcatcatcaacatgtgttatcgccgcatcttgggctaaatcatccgcagtcgcaatattcagtggtagtgtgataagcaggctggttcctttgcctaattggctttccagcgctattttaccccccattttatgaatcaattggtggcaaatccataaacctaaaccggacccaccgaagcgtggcgatttaccctcattggcttggctgaatggctgaaataaggtcgcctgtgcggcaggggagataccaataccggtatcggtgatatcaatattcatcacaccatgctgttcgtcgcttggttcccaagtaatatcaacagaaacactgccttgctcagtgaacttcaacgcattaccgagcaaattgcccatcacctgacgtactcgcagcatatcggccatcaataacggtgggatatggtcatccaaccaaccggagaaacgtaacccgcgctcattggcaataggttgatagagcgtaaacatccgctccatttcctgatggaagtcgaccgcagttggatgaatactcagttgaccagcttcaattttagccgaatcgatgatgtcatcaagcaggagcatcagtgattgagcagatttagacacggtcactagcgtatctttttcgacaggccggttactgcgaatttccagttccaataaccccataatcgcgtacatcggggtacgcaactcatggctgatggttgcgaggaaagtactcttggtccggttagcactttcggcttcaacacgggccgcttccaattgccgttcgacagttttgcgctgactgatgtctagccagccgcccaacaacccctgttccgcattattaagaggaataatccacagaaaaatatcccgtatctcaccctttatttctacagataagtcaacaagttgtggttttctattgagtaatacactgcgacaatatttatcaatttcacgatcaagcgggctggtcattggccaatgtgctggctcatgagtttgattgagcatgtcgtaaagcttatcgctgtgcacatcagcaaagtggctgttataaacggctaactcaccactcgcggtgcgaatgaatacagcaaacggtaatgcattgataatggactcttgctgcaataaacgggcatgcaacaatttggcctgacggcgtttattgaagaccaaatagcagagatacaagccgaagaccaagagcagccccgagcttattttcagcgcgatcatcagaagttcgttatccagtgagctttcatcaaaactgataggttttggtttaaaagtactccactcactggttaggttatcgaactcttccggtgggatagattcaatgactttatcaataatagtttttaattctggcaggtcagggcgtatggcaaatgccatcattaatggctcttcaccggctaccgccacggttttgatatttgggctgaaattttgtgctgacaagtagttggcggtcatcatgtttttaacgacggcgtcaactttcccttgctgtagccagcgtactaacgtcatggtgtctggggcttcaacaaaagtaattctctgtgctagcagtgggttaccaataatgctgctggaggcactgcccgcctggatcccaacccgctttcctgccagatcaccgacgttattgatatccatgcggtcttcacgggtcataatcccccatagcgattgggctattgaggaggagtagagattgttgccatactgaccattgcgcacagcaacaatcggtaataaatcgaccttgccagctttaaaactgcgaacaccttctccggtatctttggtatagaccggatcaaacttaatcccggtacgacgggcaatgatatcgataagatcgacagaaaaaccggccatttctccggtccggcggtcacggaaaatcaacggtgctagatcgagtggggcaatataggtcaccaccggatgatgttggatccaactgatttcttgttctgtcagcagcaatttagcatcgatattgtagtgatgcttgctaccaaaccagcgctgttgaatatcgccagtagcgcgggtgggtaataattccagaatttgattgaggtaatcgatcagcttctgattactttccctggccaggaatgaataaggggcagggtgataaggtgcaaaatttcgaatttgcagcgtcagcaattgtagttggtcaattaaataatttgctgatgttgcattagccacaaagacatcagcattaccataggcaacagcgagcaatccttgcaattggttggggtaagcaacaattcggtctgcgtgataattaaagagaaactcgggagacagtggctcattattcacaatagccacggtttctggatgtgtacgtttggtaggatcccaatttttgctacgaacttcaacatgccggtttgtgaagaaagcatgagaagcgattagccccggctgggccaacatgggagtgcctgccattaaatcaatttggccattctccaacgcatttaataccagcccgtaatcgcagtaaccaatcatctgaaaagagagttggctggcatcgctgattatcttcagataatccgcaacaattccttcaatggcattatcatcgcggttaaccacaaaaggggtattcgcatccatgaccacgccgactttaactgtgcgtcggcttgattggcgggtatcggtggcaggggtgagcaacaaatcgtcattgtagctgttggcgatactgtggatcgtcaagggctgcccggtatcacatccttgacgacccgtcattagagaagcatgaagctgcccgctaatcagtagcaggcagcagagtacggtacgcaaaaaaaaccagctacgtaaagaaaaccgggcacgtaaaagaaatcgggcacgtaaaagaaatgtagtacgcagtgaattacaccaaattatgggtgtgtgcataatcggctaattcaatgacagaactgagtcccaatttggtcaaaattcgggttttataggtactcacagttttattgctgataaacatttcatcggcaatctgtttatttgacagaccatttaccagataacgcaaaacgttaatttcccgctctgacaacaaccgcgccctattgacaggatcatggctggaaggttgcccagctaattgggtcaacgtttctgatgggaagaaagagtaaccacgtaatacgttttgcgccgcaaaaagtatttcactaatatctttattcttactgataaatccattagcgccagcttgtaatgcccgcactgcaaaaacttgctcattcttggctgacaggaacagtgatttgccggtaaaaccacgttgctgcaatttttttagcaacgagaaaccatcaaaattaggaagctcaatatcgataataaccagatcaacgggattattttttagtttttccaatgcttcactgccatcaacggattcactgatcgtcgaaaactctttgctttgtgatagcaatgcatggatagcgacacgaatagctgggtggtcatcaactatcatcactgattttgtcatgtactctccgtaaaccgttatatcttgggattcgcagagtgaacttactgctcctcgcgtgcaccaagagacgctaaatgtttacccaaggtgaagtaaacaagaacccctactgtcgatgcccaaagtactatttcggtgattctaatccctaattatagattatcaagaaaagattcttgcttacctatctgcaacattcactaaaagtgactgaaaggcttctgttgcttagttagttgataataaacgggttaggattttttttagctaaataaaaatagccatttcagaaaagccgagaagaaatagttaactcatcatgctatgagtaaatatacccgatttttcagcgtttgttgtaggaaacttcctcacgttaacgtggtgaaaacaattgtatatacatatcatatagatagtaattaatttattaatatgacaatcgagggcaacgcgatgaaatggatgatattacattgaatcgcttgaggtaatctgacgagggcgcaataccaaaacacgtggagagattttagtcagataggattatttgctttataaatgggaaaataacgccaaaaatggtgatgtttttacgctttgtcatcacggttcagcggctcgctggccctgatgaccgttgcagctacttacaataaagtttgctggcgctgcattgccatttgttgctcgctaatctggcggcgcccaatcatttgtttatcacccgcctgcatgaccgtcagggggaaacaccgtatagcgctccccatgccggagagcgaaaaatactgtttggcagagtgttgacaggggggttatctcagattagatgcatttttttagcagcctgcgttagctcatcccggaaatcaggatgtgccagctcaatgattctcagcgcccgttcagttgaagaaagccctttgaggttaacagcaccaaactcggtaacgatatagtgggtatcgatacggggtgtggttaccggtccgtcaatgcggggaataatacgtgaaacagtacctttcgccgcagttgaaggcgtggcgatgatggagcgcccacctttagaggcgtatgcccccctgacaaagtccaactgcccccccgaagcgctgtattggtgtccaagcatatgttcagaattacaggcacccgtcaggtcaatttgcagggtcgaattaatggataccacgttgtcattttgcgcaatgatgtggggatcgttaacataatcgaccggccggctgaaaatcgctgggtgatcgttaaggtattcgtacatttcttgttgccccatggcaaaagtgaaaacagacctgcccctgtccagtgtttttcgctggttcgtcactaccccccttcggattaaatcgaccagtccggggttcaacacttcagtatggatccctaggtcattgcgatcttttagcactccacaaacgaggtttggtagcgcgcccacccccatttgtaagcaggcaccatcaggtacgaggtcagcaatgatgtggctaatagatgtatattcgggtattgctgaacgtactggcatctcaatcaaagggacatgattttcgacaatggcatcaacttcagcgatgtgaatcgccgccgcttccccctgaacgcgcggcatataccgattcacctcaacgatgaatcgtctggctgaacgtgcaattcgggatgaatagtcatttccaacaccgaggctaaagtagccatgacaatccatcggagaaacggtatgcatgaacgtatcaataccaatttcttcggccagaagacgtggtgcttgatgaaaattagatgggacataattgacaactttacgcccaccatcctctatgcctcggcgaatgagcgcccgctccacggcagtgacgaacatgctatagggcttgatgcgattatttagctcatagcgcagaatagtatcaccggcaattttggccgtttcaaaatagtaaacgcgtagatcgccaatatccccccttgtcgccctatctgccagcgccttcagcagcgcgggtggttcagccgcaaacatccccatagagaggtgactgccggatgcaatagaggaaacggcctcctcaggcgtggtgagtttctcgtcatacaatgcacgtatatccatgatataaccctcgctgtttttctcagtatcctgccatttcttctggtgagtgaccgcggcgataaaccagcatcgtgcgttcgaagctcatcacctctatgccatcttgattgatgccacgggtttgcaccgtgacgatcccctgacctgggcggctgtttgacaggcgtttatgaagtaccgtactttcggcataaagcgtgtcaccggcgaacaccggatgggttgctttcaccttgtcccagccaagattggccacgactttggcactgaccgtacgcacgctcatgccggtcaacagcgctaaggtgaatgttgaatcaaccagtagtttcttccattcggttttgctggcataagctgcgtcgaaatgaacctgctgtacattgagtgtcagtagggtgaaccacacgttatcggcatctaaaacggtacgtccgggtcggtgctcaaaaacatctccgggggtgaagtcctcccagtagaggcctgaaatctcgcggtagcggcaatcaccaactgttttataagcagataataaagaatccatagcactatcctccatcagcgacagtgaagtgtaaaacaccgttaaatcaatagataaagtgatatcaggcagagatacccgctcgggtaagtacccggcgggcctgacgtgcaacagcctcatcgatcatcattccgttgacggtcccgacccctttggtattctcggcgagcactgcgcgggcatggcgtatctctgctgcagtgggggtaaataaggtattgattgtgctgatttgtgcgggatgaatggccgcttttgcagaaaagccgaaatcagatgcgcgaagggtctcagactgtaggcctgaaacatcgtggacatcaaaaaaaggggcatcaatagcgggaatgccattcatcgcacaggcggagactaaccgggcacgcgccagcgctagcggttcccaggtggatgctgcgccaatatcggcggccatgtccgcagcaccaaatatcaatccggccaattttggggtggcagcagcaatagactcaacagcgttgaggccacgtacagattcaatgatgccgataaggcgcgtatcagagcctgcgaacatcattaggcgatccagaatctgcagatgagccgctgactccgttttaggaaggactaggtaatcgggaaggctgccacattcgagtaaggcgtgaatatcctcaataccggcacgagtatccagtccgttgatccgtagtgccagcggtagtgatgtagccggacgtgaagagagataagagatggctttttgtcgggcctgctccttatccgcttgagagaccgaatcttcaagatcaataatggcgacatctgcaccgttttcagccgctttagcaaagcgatccgagcgagtggctggcgtaaagagccaactgcgggtttggtaagtatcaagattagacatgatgttcctcctccaacttcgcttagtctatggtcgccgttatcatttatccaatatatgataccggtgtgtttaattgcttttggatatgaagatggagttacgtcatatacgctattttctggctgttgctgaagaacgacatttcacacgcgctgccgcccggctaggaataggacagcctcctctcagtcagcaaattaaggatctggagagggaactcggtgcgttgttgttccggcgggtttcttatggcgcagaattaactgaggcaggtattgcatttctggatgttgtcaaagagatacctgtgatggcagaaagagcgacccaagctgcgcagcgggctgtcaggggagaactcggcgtactcagagttggctttactgcgtcatcagcatttaacagcgtagtgcctacggcgatccgtgcctttagacgtgcatatcctgatgtacgattacagctagaggaagataacacgactcgactggctgatggattgaatgaaggctcgctcgatgtcgctttcctgaggccaggctttgctggcagcgaacgtttccacctcagaatgctatctgaagagccgatgatgattgtcatggcggaaaatcacccggcggcatcgtatgaagaaatttcgcttagcgcattcagggatgaaactttcctgctatttccacgagagattggtctgacgctttacgattcagtgattgagtcatgccgtactgcgggttttgagccgactattggccaactggcaccacaaatcgcttcggtcattaatctcgttgcggcagaaatgggcgtttcaatcgttccggcttccatgagccaagtgaaagttattggggttgtatatcgacacattgctgaccagacgccgacagcaaagctcgcgttggcgtaccggcgaggggatacctcgccggtattaagaaactttgtcctgaccgtgtttccttgagttctctccgtcggttaaggcgactctataggttaaaacgatccaatcggttaaaaaacgccccaagagcaaaattattggctatcaatatccggcctgcatacaggattattatccgagtcgccaatatcttttcttgacagagacacgtcgcaaaccagcgtaatatgatcacgatatgaatacccagagaaagcaccacccaggtgagaacgcttatatccggtgatctccaacgggccttgttcaataatgattgaccagttattcatgcgatcttgtggaccaatgggaataaaaacattccactcgccttgcggaataaacgagaaatgtcccttggtatcggtggtggttgtctgtactttttgatcaaaattcgctaaagaaactttcacgccagccaatgtttgcccttgatctgtgataacgccgttaatatgggggctaccataattatggtatacacacccgcttaaaaaggcagagccagacaaaaccaaaaacagtgataaaattttcttgcattgaatgttttggttaaacattaattaataatcctattttttaaattatttatcactattagggggtagtaaagactggatatattctgctgcttgctgttgatctaatgcgtcgcgttcacagagttcgatatcaaatgcttttaatgcatccttaagctgattaattgactgagggatgtcatgaatacagaaaatataagcattttcaaacggtgcaaggtcaactaacctcagtttgtattgttgaagataagaattcatatgctctaagtaaggcagttgatatgggagcataaagtaatcgacttctgcagtcatcgggtcaatgctgtcccaatcaatcccatcaaccagagatatgacaaaatcccccatattttccggtaaaaagagacagtcaagggacttcagctctggcgtgtatccgcaatattctttccattcttcataaaccatcagctgttgttggcttaaatgggtataaagccagttcagtacgtttccttgatccaatttttcgagtttatttgcctgtaaaggctcaatatccagcaagggtatactttgtgctaatgcgctgattaattggtttactgcggtcattatgttcgtccttgggcgctaaatggttatcatataccattttaatttgtgtggataaatgaagtaacacaattaattatgagacgacgctattatatgcttggcgagttagggcgatgatccaaacggatgcgttgctttctgttcactgttgtacaggcagcttagaagcataaatatcagagaaacagtctgatgctcatggccataaatcgtcacttattctagctgtttatttttggtctcgggcagcaataggctcattaccaatacgatgcaataggcactgccagcgaagactccaatggcaaatgccagactgcttgactgactcagatagccgaccagccccggaaagagtgcaccgacggcacgaccaaaactataggtaaaaccttgtcctgtagcacgtaccgccgaaggaaaaagctcagtgagaaaggcacccatgccgctgaagatcccggatgccgaaaagccgagtgggaatcccagaacgagcatctgcgtgttggtcagcgtaagttgggtataagcaaaaattgttatacacgacagcagtgagaagataatcagatttgcccgtcgcccaagtttgtcggtgagataagcaccacaaatatagccgacgaaagagccaaatataatcaccatgagatacccaccagtaccgatcaccgagagattgcgttcgagtttgagaaaagtgggcagccaagttgtgatggcgtagtagccgccttgcactccggtacagagtaaagaagccagaacggtggtcttgagtagcgcgggggagaaaatggcgaaggaagaaacgcgtcgatccttggcttgctgctcgtggcgggatttcaggaataacgcgggttctgggacgtttttacgtatgtagagtactaaaagggcgggaagcacaccaatccagaataatgcgcgccacgcccactcctctgatagtaccgagaacattagcgtgtaaagcaaggctgctgcaccccaaccaatcgcccatccactttgcacggtgcctacggctttcccgcgatgttcggcgcggacgatttcccccatcaatacagaacctacggcccattcaccaccaaaacctaaaccttgtagcgcgcgtaggatgaaaacgtgttcgaagttctgagcaaatccgatgagtaccgtacataaggagaaccataaaatagttatttgcaggatacgcaccctgccataacgatcagcaaggatacctgcaccccagccaccaatagcggagaaaagcagggtgacggtgctcagcattccggcctggcctgcgtcgatttgccagagagccatcagcgtagcaatcacgaatgtaaaaaccatgaaatctagcgcatccaatgcccaaccgccaaaagcagcaatgaaagtttttctttctgtctggttgagatcgctaaaccaacgcataaatatctcctttacagactggctttttaactcttgtgagcacctcacaagttattttgttatttttaaaaatcatatagacgagcagggttatcgaccaagatccggttgcgcacctgctcatcgggtacccaagcggcgagcaaattgcgtaatcctccggtatctggcattcgagataccgagacatgtggccagtcgcttccccagaccatgcggtcaggtgcggtttcgataagcttttgtgcaaaaggcacgacatcgagatagccgtcttgccatgattcactgatacgataggctcctgataattttacccaccatccatattctctgaccatatgcaacaatgtctgatagcctgggtgattgagtcccaatgacacaggcatatgtcccatgtggtcgatgacgcacggacaaggcagttttttcattcgtggtatcagtgccgggagctgtcgtacatccatcaggaactgcatgtgccagcccaggggcgctatttttgatgctaaattttccatggcatcgaaaccgattcctcccccgaacagcacgttgatgcgtagccctctaacaccggccaatgccatgtcttgcaattcttggtcggtgacatcttccgtcactactgccacaccgcgtaaatattccggatgccgtttcagtaccttaagcatgtaacggttatctgaaccataaacgctgatctgtaccaagacacctcggctcatacctgttgctgcaagcatggataggtatttctcttcaggtgctggtggcggggtataactgcgttccgccaccatggggtagatagcgcgaggggagataacgtgtgcgtggctatcacatgcatcttcgggtagcgcaaaaatcgaaggttccataatatcgaatgggactgggcagttagcagaagagtttttcattgttaaacacaggtaaaaataaaattcagattagaaggcaattattgatatagaaagcgaatgttttgatataaattaattgacaaaaatagaacaaaccagaacaagaatatgacactgaaacagcttgaggccttttattgggcggccagatgttctaatttttccattgctgctgagcggctgcatatttctatctcttccttatccaagcgaatagtcgagctggaagcgtcactggggtgtactctttttgaccgctctggataccgggcggtgttaacggagaccggtcagaacctgctaccgcgcgcatttgcattgttggagtctgctgctgaaatccgcaatactctgggcgcaagcgaaggtttgtctggcatctgtaattttggcgttggagagttgagcgctctgacgtggctgccgagttttattgcttcagcccgtttgctttatccgaagttgcttttagcgccacatgttgatgttggtgcggctcttgaaggacgagttaataagggcgaaatggattttgcgatcattgcggggcgttcttctcggcagaatattttgtcgttgcccattgctcaggcgcagtttgtctggatggcatcgccgacgttagcaaatactgtcggtaccgccgacagtgcgttacggcaggcgcttcctctgattacactcccgccaggagcgggttctagccggattatcgacgcttggctcatggcatatggaattgcctcggtggcccgtatcaattgcaacagttggggggccattgtgggtatgctcattgcgtcagtcggcatcggcattctgccaacaagttgggctgaaaagctttccctacacaatcaactggaatatcttccttgctctgaacctttagcagcattgaattactccttccaatggcggcgtgatgatccacgcccactaatcagaaaaatgcgtgtgttggttgccgacctggccgatttctcgctaaatagcccactgccactaaataattcactgccgctacatcattcactaccactacatcattcactaccacaacgtgattaatttagtgtgcaaattccgcatacatttagctattaggtggtaagttggtcaccttcaataatcgcaatccaaggatagacataaatagtgtcgtcaacgaaaagagggatgtttcgatattcagcgaagatcacaaacaaattcagcgaaaattacaaacaagctcaacgaagatgactaacaaatttgtgataccatttaagcgctaattctgatgatgaacaatgattctagtttagaaagaagaaatgacttctgagccgcattgtctatcataaataactgaatgtcatccacgtccgcgttagagccgaatacctgaaaatgacataaatcctaaggacatcagccctgcagtcataaagacgatgccgagcccttgcaacccttttggaatgttagagtacttcattttttctcgtaaacctgccatggatataatggccagcatccaacctaaaccacagccagtcccgtaaacaaaagattcggtgaacgtatattctcgctgaaccataaaaatggttgcaccaaatattgcacagtggatcgtcagtagtggtaaaaaggcccccagggtgtgatgtaagcttggcaaaaatcgctcaagtaccatttcaagtatttggactaatgccgcaagcaccccgatgaaggtaatgaaatcaagaaaactaagatccactccatcaatcagagcattctctctgagtatataggtgtaaataagattattgagaggtgttgctatcgccagcagggctgtaactgtcaacccaaggccaaaggctgtttctacttttttagatattgccagaaatgtgcacattccaagaaagaaatttaatgccatattttcaacaaaaacagctctaataaaaatggtcaaataactctcggtcattacacacactcctgaatcgtccatatggagttacattgtatcattatgttactgattatttcttaatatatttcatcctgacggcttttttagaattatcttgaaagctacatttggtgagtttaattcttttctaattgcggctctgacatcacaactgagagctagcaagaagaattgatcattattatgtagcgatagtcttaactgtgagcaagggtagatcggtgtatcaataagaccctgttagtgttagcaatagggtagaaagtgaaattatgttgacgtaatgagcagcgcattttactttccataaatgccaaattggttgacctttgtggaagaactgcaatgaataaaattataacggatcagcgtcaccaattttcctcacgagtgaatgaccttcacccgtcgccaattagggaaatactgtctgtcattgatcgtccgggaatgatctcgtttgccggcggattacccgcagtagaaagttttcctcatatgagccttgagggaatgccgcagccgatgctgcaatatggcgcgagtgaaggggagttggaattacgtcaacagattgctcaaaatttgtgtgagcgaggtttatcctgtactgaggaacaagtcctgattatttcaggctcacagcagggcattgatctggtcgctaagttgtttattgacgagggaacccccgtcgccgttgaatcgcctacctatctggctgcgttacaggtattccgttttttcggtgctcaatttgtggcttatgattcaactcagcctgatatcgacaagcttcgcaccgaaaaacctgcttttgcttatactattccgaccttccagaatccaagcggtcactgccttgatactgaacaacgagagttactggcgaagacatgtgatgacattatgttaccgctctttgaagatgacccgtaccatgacttggtttatgacccttgtgagcgtaagccagtgtgtgcttcattacagcgagcttcgtggatttaccaaggatctttttctaaaagtttatccccggcgctgcgtttgggctatcttgtcgcatcttcagaattgattccctatttgacacgtttaaaacaagccgcagatttgcacagcagccggatcagccaatggttagtgttacagcagttgcgtagccctaggcatactgagcatatgcatgaactggcagcctattatcgaactcgccgtgatgcgtttgaaatctccctacaacgccattttggctctcttgcgacgtggaaaaaaccggctggagggctgttcttctggttaacccttaatcgctgcatagatactcgtcaactcttgcctaaagcgctggcaagcaatattgcatttatgcccggagagtcgttcctccctcattcatctgaaggctgcggtcagttacggcttaattttagccatgcgacggaagaacaagcggatgtagggctgaaaatattagcgggtttagtgcaggaacatgcataagatgggctatcggtgaatctcattgactcattaattgaagacgctgaatgaatcgaaataaatttcagatggaccgagtaacgaaagctgccaacgcacatgcagcttgaagtataacgagtataaattataaaaatcaatccagcctgtaggtgtaataactggcctacaggctgctacagcatgacaaccgtattaacctactgatttttgctcatataactctttaggcgatacattttgagcatcaggttcttcgaacaatatttcttgtgaccagacatctatcggtgcggccgctacctcattggcgcgtttacgcagactgaaccatccggcgatcagtagcagtgtgagcacgggtatgctagcgatggtccaggtgccatttggatagtcaaaggccatcatcaccaaaacgcccgccaaaaagatcaatgtcagccaagatgtcactggcgcaccgggcattttgaaggagacaggttttgccattcctctttttattgcctgacgtaatttcatctgacaaatgataataaatgcccatgaactaatgatccccaaggaggctatattcaggacaatttcaaaaacttgagagggaacgaggtagttgagtagtacccccaagacataaatgcccacagtgaccaaaatccctgcatagggcacggattgcgggctcatcttggacataaatttaggtgccgatccccccattgacagtgaacggaggattcgcccggtcgagtaaagcccggagttcaaactggagagtgcggcggatagcaccactatattcataatagtgccaatgtaagggacccccaagttactgaagaatgtcacgaatgggctttgacccgcttgataagcatgccagggtagcaagcagaccagtaggacgacggagccaacgtaaaacaaacctatacgccatatcacgctattaatggctttgggcagcattttttcggggtctttacattcaccagccgcagtgccaattaattcaataccggcgaaggcgaatataacgccttgtaccattatcagggcaggtaagaggccgtgaggaaagaaaccgccgttgtcggtaatcaaatgaataccagttgtatgacccgcgacgctttgacccgtaccgaggaagatcacaccgacaatcaaaaacagggcaatagcggcgactttaatcagtgcaaaccaaaactccatttcggcgaaccatcttactccaatcatattcatggtagcgacaatcgagagtgcgcctagggcaaacagccattgcggaacatcagaaaatgtcccccaataatgcatataaagcgccactgcggtgatatcgacgatgcctgtcatcgcccagttaaggaagtacatccagcccgcgacataggatgctttttctccgagaaattcacgggcgtaagaaacaaagctgccgctggtagggcgatgtaagaccagttcccccaaggcccggagaatgaaaaatgaaaaaattccacaaaccagataaaccagtgctaatgctggcccagccatttgtaagcgggcacctgtacctaaaaacagtcctgttccgatggatccgccaatggctatcatttgtatatgacgtaggcccatacttttgtggtaacccgtatcatgagaatctaaccagcgttttttcgcggcgtgatgggtctccgcagagtgttttcctgacatcataaactttccctatattcttgtctgtcggcaatcattgtgaatgtactacagcaaatgattgctaaaggttaatgcataaatagcgtcttagcgccttcagttattatggtttttatcaataccagtggatctcgggggggcatgctatcgtttcttctgggatgaggcaaaaaaatattcacttataaattattttttttgctgtattagtgaagtgagtaatcatttactcatgattaaatgattaccatcacgggtgtcatggcgtaaaactattccccataattattcataaaccaacaagaaaactgtaaccacttgttaaatagagtaaaaataaataattggttagccgtgagtataaattatatttgtacgattttataattaatatatttaaagattaattttattattgaaagtatactaatctattatattgcattttatcttatttcatatgtatctaacccatggaataagatttatttatttttataaattataatttatttaattaaacaggcttaatatgtctaaggacatcaatggtgaatggattattatgaaaagcattaatgatgaataaatagttgttcgcctttaactattaaccacaataatggggtcgctgcataaataaaggcggaactgcctgaatcatgatcgattttttaactacgctcaattttttagctaccactttattttaactatcaccctctttttaactatcaccttctttttaaccatcatcataagtactaacgcggaggagaggcgatgattaactcgagtgctttttctgccagttcctcatacacggtggaggataaactgttgtcagtgataaccacgtcgaatgccgtgagtggcaatgccagataagtcgcaaccttgccgtattttgatgcatcagccagcaatacacgcttactactggcctcactgatggcgcgctttacggggactttatcttcatccggcgtggatatacctcgaaggccccagcaggacgcggaaataaaggcaatatcgatggacaggtttctcagggaatgcgcggcagcctctccgatacaagagcgatttttacggcacagcgtcccgccggagtggatcatcctgcattgggaggattcgatcaaaaagttagcaataacaaagtcgttggttaccactaacagatcatctctgtcctccagttgacgagccaatgccagcgttgtggtgcctgcatcaagataaatacagctattacggggaatatgcagagcagccgatgtgccaatagcctgtttttggcgactaaacatcatcgttttatcctgatgagagggttcaattgccagccgttgtgtcgaacgcaccccgcctgaaacggacaatactgcaccttgctcttctaatttctgcacatcgcggcgtatggtcatatgtgatacccccaaacgttccgttagttcagcgatgctgaccacgccacgttcagcgaccagtgccaatattttttgatgacgttcaatcggtatcacgtgtacccctcactcagttaatatacgagagaatagatgatgataattaatgtgattatatgccagcaataaaaatgtacttctcattttttaacgttaattttcacctgaaaaataagatcatcaccaaaattaacattggagaggttaggggcgattgtcgatgacctcatttgtcctgatgatctcatttgtactatagatatcgccagtttccagcgagtaagcgatagtcaggcagtgttgagaaaaatagttttggtgtttcattaactggtcagtctatgtgatgaccggtgccttcctgcctgtatacgtcgagaaaattgccaataaatatttatcaataacgtgctctatacggcagatatatttgctgaatgtagtattagcgtcataattacagtattcagcttgaaaatagagtctaattctctttttcctgtcaatgccacatgtcgaacgggtcaatcttattgggcgttataatgtagttgcgcaactgaataccttctatacttaaataatggcgagtcagctgcaaccgtttaattgcattcatggtgcggcttcatagggactattcaaatcacatcggcacctgatcactataaattagatgaagaggagggcaatcatccgtatttattgattctgtttggttgtattacctgtgctggctgggctgattgtgagtatcagccattagtggctgcgacacaagtattggccttgggggagccccccacctctctgtagtagacttttgaattattgcaaaaaatttcattgcaaggctattttatgtgaagaattttcactttattgcgttaacaatagaccatttaaagtgtaaggttaaatggctatgccatgataatttttaggctttaattaacgtatttcgcgccacttatttttcttttatgccttgtattgctatggaatgctaaccgcatcgacacaggcttatctttttcgtttggatataatcaaattgttgataacaagtgatatacagctctcttaacctacgttatcttacgatgagaatttcatgatgaaattataaaaaacaggatgaaaagtgtagtgattcgttgtcactattccatttaatttaaaacggaataaatattcctggcgctctaaataggttctagaactaaaaagatagaaaataaacaaaaggcgaatggagataacagatatgccgacagatgatagcaataacggaattatcgactacgtatcaacaggtcatctacctgacccggaaacagtcgttaaattagtgcaagaagcccataagcgatttagtacggatactgctggtgtggtttctaatgtttatccggcattagagagaattcctgctgatctctttggcatttgcatggttggcactaacggcaaaatccactctgctggcgatgtggattatgaatttaccattatgagtgtttccaaacccttcgtttttgcactggtttgtcaggctattggggcgaagaccgcccgtgaaaaactcggggttaacagtaccggtatggcgtttaactcggtaacggccattgagcgggcatcggatggccgtacaaatccaatggttaactcgggtgcgattgcgacgaccagtctggttcctggcgcgaccagtgatgaacaatggaaattcatttatgacggtttgtgccgctttgctggccgcgaattaacactgaatgaagaagtataccaatcggcttgtgaaaccaatttccgtaatcgcggtatcgctaatgtgctgcaaggttatgggcgtctggggtgtgatcctattatcgccactgatctctatacccgccagtgttcactgaatgtcagtgcccgagatctggctgtgatgggcgcgacattagcggacggcggcgttaacccactgactcgtgagcgagtggtggacaatgatatctgccattatgcattagccgtcatggtaacggcagggctgtatgagacctctggagactggctctacgatattggcctgcccggtaaaagcggcattggcggtggaattgtgacagtgtcacctggcaagggagggttggggacgttcgcaccgttactcgacagtgcgggtaacagtatcaaagggcaacttgctgctcggttcttatcacgcagtctcgggatggatatgttcgtttctgagccttacaccgaaaagaattgatctgtgggatatcgatgttgttctgaaagccaggcggtcttggcaatcaggttatatcgaaaattaagttgttctaaaaacaaaaaatagatcaaaaggatagaaaatttatggcaaatcaatcagtttctcgtacaggtacggaagttaaggagtcctgggtgccgatgattaccatcgcgctggcccagatcctgatgtcattcaacgtggcctccctacctgttgcgttgggcgggatggtaaagagctttaatgtgccaccaaccactattgccacggcgatagtcatgtactcattgtcggttgcaggctttgtgatgttgggtgccaaactcaaccaacgctttgggccattgatagtattccgctgtacagttctgttattcggcctggctcagaccatgatgacattcagcccgaatgtcactgtaatgatcggtgcgcaggcactgagtggtctggcaggtgcggcattggtaccggcactggtggcgttaattgctgaaaactaccgtgggcctcaacaggccaccgcactgggggcattaggttctgctcgcgcaggggcgggtgttgctgcgttcctgatcggcggtattttgggaacccatatcggctggcgtccagcgttcggtattttgattgtgttgtctgttatcgtttttgtactgagtttccgtctgaaagcagataaaggccgcccagaagtgggtattgatgttatcggtgtcgttttagctgcatctgcgattattttgttgtcgttcggctttaataacctgaaccgttggggctttggtctggttcgtgacggcgcgccgtttgacctgctcggtttctcaccagcgccgtttatgatcgtgttgggtatcgtcttgggtcaggcatttgtggtctggacccgccgccgtcaggagcaaggtaaaacgccattactggcgctagacgtgattacatcacccagtgagcgggcggcggtatttgccatgtttgcggtggttgcgctggaagccatgctgaacttttctgttccgctgtatatacaaatcgtgcagggcagttcgccgatggcaacagctatcgctatgatgccgtttaacctatcggtattcttctctgcgatgctgattgtacgtttctacaagaaactgactccgcgtaaaattggtcgttacggtttcatcacttgtactttggcgctgttgtggctggcattcgtggtacgtaataactggagtgagtggtcggtcttgattggtttggtggtgttcggtatcggacaaggctcactcgtcaccttgctgttcaacgtactggtcagtgcatcaccaaaagaattggcaggcgatgtgggttctttacgtggtacgaccaacaatctggcaagcgccatcggtacagcggttgcaggtgccttgctggtgggcttgttaagtgccaacgtgatgcgcggtgtcgctgaaacgccgattctgacggatgagatccaagctcaggtcaatatggatagcatcaacttcgtcagtaatgatcgcctgaacagtgtattggctcaaacctccgcgaccccagaacaggttgccgaagcggtgcgggtgaatgaagaagcacggttacgtgcgctgaaattcggtttgctggttatggcgctgctatcgctgttggctatcttccctgctggccgcttacctgactatctgccgggtgaactgcctgctgataatctggataaaaaagccagcaagtaagttgctggaggttattgacaaagtgcccgcgacggagagaacaggcagatcgtaaagacgccgtaaatacatccatgtaggctcgagccgcgccatccttggcgcggacgctttactcctctgcctatcctcaccgttcaagatcgcgtcatcgggttttgtcagcagtctgcagcaagtaagttgctgttaaaatttaattttttgaaatataaaatgttgaaataaaagtgactggcagtgtgttgcgaaagcagccactgccagttttttctttctggctaccgcgacttatcccctctataacccaaaatccaaaatctatcttgaagggcgatgggtatataactcgaaaccacgactttgctttagcgattagcattatcttcaatctgcataattatcttcaatctacataattatcttcagtcgatggcggcactttccctatattggtggggtaaattgcgcatcagtacgcattttttgaaaaaaatttcagaaggttaaatgtttcttgatactggtcaagacacatttcctttgtttagtgttaatgttaataaatctcattattaacttcatgtacattaatcattatgcgcatttggcaaaaattcttgctgctcttctgctgttgggtgttatctggtccgctagtgtgggcttcaacagactactcactgtgggttaatgatattcaatcccggttagataaaacggctcagttgtatcaacaacaaaaaactgatgaagcgagagcaatggtacagatggcgtattttgaggtgtttgaaaaccttgaggggccgattcgtatcaacatctccgcgcaaaaaagcttccagatggaggcggcctttggcgagataaggcggatgattggtgaaggcaaatcacaggctgatgtcgataataaaatcaattggttgaaaggcgaactaacgggtgtcttgcccgtgttagttgatggacacaaactcactgctgagcagcaacacgctgcttatgaaaacagcgatattgccgtatattggcaacagagctttagaattattgatgatttattggcgcaagctatcagtgaatatcaggacggcaaatatgccgaagccagtaaaagtgtgcagcaggcgcattatcaggggtttaaaaactctgaaatggagatgtcggtgcggggaaatcgctcggcacagcaagcagcggagataaatcagcaatttaccgccttgatcgatttggcgcgccagcccgataaaatgaccgaagtggcctatcgtgtcaccgggttgctacacaccattgaagacatcttaccgggcttaccaaccactcgcgaacaacaacaaattactgttgaccaacccatctcttccgacgccatccccgatacacaagctaatgctgattgggcgcaggtatccagcaaaatcaatcaagcggttactgaggctatcgggcaataccagcaagggaaaataacaccggcaatgatggcggtgcaggatgcctactttgacttgttcgaagccagtggcatggaaaacaaggtgggatcgcgtgatgcagcatttaaatcaacgttagaaggccacttcacccgcttagttggtttaatgaaagctgagaaaccggttgagcaactacaaaccgaagcggttgccttgcaaaaagatctggtcaatgcagccgagatgctgggtgatggcggagagaccgactggagtctgttcgtttacagtttgttgatcattgtacgtgaagggctggaagcattactgattgttgcggccattgtcgcttatttggtgaagaacaaccatcaggacaaattgccgttgattcgtcaatcggtggtggtggcactcatcgccagcgtattaacggcattcatcttccaatggttgtttgccaactctggccaaagccgcgagttgttggaggggttcaccatgatgattgcggtggtgatgctgttctccatgagttattggttgttatcgaaggctgaagcccgtaattggaaggcgtacctcgaaggaaaattcgctaaatcacttagcagtggatcaataataggtttatggctcactagcttcctggcggtataccgagaaggggcggagaccgttctgttctacctcgcattgataggcgatgccaataccaccagcggccacttatcggttctggccggttttggcgttggttgtgtgatcttgctggtggcttatttggtgatgcgctttaccgtggtcaaactaccacttaaaccattctttatatttaccggtggctttatgtacctgatggcatttgtttttgccggtaaaagtgttctggaactgatcgaaggtaaattgtttgaacccactttactgccgggtgtacctgaaattagttggttgggcatctatccttatgtggaaacgctgatcccacaaggcgtgttactgattgcagcattagttgccctttgggttatgcaatggcgtagtcggacggttcaccgctaagggactgttgaccacagaggaatcgttggtcacagaaaaatcgttggctattgaagggcgattcaccatttaagggatattcattattaaagagtatcccccattaagggtttgcgacgcgaagccctgaatgagcagtttggcaaaatgccgctgcgaataacgacaacgtaattatcatttgataccagagggtatgtcctatgaccatgaagaaaacaattattgccagcagtattattgccagtatttttgccgcacctgctgctttggcgtttaaagaatatcctgcaggcgagcctatcaaaattaacgatatggaaattgctgctgtttatttacaaccgattgatatggagccgcgtgggatgggtttacctgcggcaaaagctgatatccacctggaagcggatattcacgccaccgaaggtaataaaaatggcttcggtgcaggtgaatggataccgtacctaaccatcgcttatacgttggtcaataccgatactggcgataaacaggaagggacattcatgccgatggttgccagtgatggcccgcactacggcgcaaatattaaaatgatgggggtgggtaactataaagtcacttatcacatcagcgaaccgtccaaagcgggtttacatcgtcacactgacagtgaaaccggtgttggtcgttggtggaaaccattcgatgtgagctatgactttaaatatgtcggcttgaattgataaccgtagccgtgataactgatacacagcggtcacggcatcgttttgaacgttattgtcattgaaaataaaagtattgttttgagaaaacattgttttgagaaaatattttttgaggaaacattgcatttaggatcaatgtgttgcctttaaagctacggtgctattttgacaataacggtatagccttgacgcgagacggtcagtttaaccattactctcaattccatttaaataatcagtctatgctatgcagtgataactggcaggtgctgtgacttcctcgcccaagggatgccaatgagttattttttcatatccgtactacaagcctttttacctgtggctctgttattggggctgaactgggttgttcggccagcaccagtactgaatcggatagtgtggataaccatactgatggccatcgttggcatctggatgggtaattattatccaaaatcgcaacagtggcagttggcattggcggggattcaactcctttcactactgttattcttatgtagccaatttatatgtcgggtgtcattaggctatttctggcaagcattattggtctttggtgcggcattgaattggggcaacaaccccaatctaggggcgctcactaatacccatgttattaatactgatttattgctcaatctggctgccaccgtggtggcatttggctgggttatattctgcgccgtattattattgatgatggtacgacagttgccacgttgtcgcggacccttgctggtcgcactcaccctgctattgatcttgcctattagcggggatgtcttcctgctgcttatgaagttacacgtggtgccgctaaccaaatcactccttagctacgtggctctggtgaccaacgggcatgcatggcttaactatatttgtgccttattattagcattcacggtgctgtgctatttgtggccgtggagccggtcccgccatgtggtcagccaaacgtcagaagccattgccaaacgtaaagcgctggcagcgtaccgcaatgtccggcgaattttgtttttatcgttgctggcattggtggtggtcgctgcggctcagttttattgggataaagtggcctcgcaacctcctcagttatcagaagcattgcccgtgacactgtcgtctgatgggttggtccatatcccggttgagcaagtccgagatggcaaactacaccgctttgtctggatcgctgatgacggcaaagccgttcgcttctttattatcaaccgctatccagaccgactgcgcctgagtgtggtcttcgacgcttgcctattgtgcggcgaccaaggttatgtcatggaaggtaatcaggtcatttgtgttgcttgcgcggtacatatcttcattccctccatcggtaaagccggtggttgtaacccgatacctctggaaaattggcagagtgatgataacgagttgattattcccagagcgtctttggcggcgggcgtcaattactttacgacggtggtcacactggatgtcgttgatccggttgataagagccatctgaccaatcaaaaatccgagtataaatacagctatggcgggaaaacctatttcttctcctccgaggcgaattacaaccgtttccgcgatcacccagaacagtttgtcacgccggtagccggcgaaggtgatgccagcgatgatagacaggagaacccataattatgttatggctgatgctgaagcaatcgtggtttagaaacgttcggcgtaaatcgctggcggtatttacggtgtttcttgccgccgggcttatctcttcactgctggctgtttcgatcgatattggcgataaaatgtcccgtgagcttaagtcatacggtgccaatatattgatagaaccggccggtcaggtcgcactgccgtcgctgtttggcgagcgaagcaatccactggctgggcaggattttcttgaccaagctgaactccccaatatcaaagacatcttttggcgtaacaatattgttggttttgccccgttactcagtggtgaagtcgacgtaaatggccatcttatctcactgctgggtacctattttaaccaacctgttgatgtccccgatgaagagaattatcacacgggtcagcagataatcagcccatattggcaagtggcgggtgattggccgcaagagccggttaaggctggggccacggaggttcaggcgctgttgggtaagcagttggcgcaacaaacgggttggaaggtgggtgatgtgctgcctcttaaaggtgcatcagggccgttgacggtgaaaatcagtggtgtattgagcagtggcggtgaagaagaagggcgcttggttctgccattagccgccgtgcaatctctgctcggattacctggaaaggtccaggcggtgcgggtgtcggcactgacggtgccggaaaatgagctatcacgtaaggcgcgggataatcttgaagcgcttaatgccgaagaatacgatctctggtattgcactgcttatgtgtcgtcaattgcccatcaattagaagaggcgatatccggctctgtggtgcggcctatctggcaagtcgccgcgtcagaaggcgtggtgatcgagaaaatacaactgttgctggcggtagtcacgttggcggctttgatcgccgcggcgatgggtatcgcatcattgatgaccagtaccattatggagcgggcaaaagagattggtttaatgaaggcactgggcgctcgtcagtggcaaattttaatgctgttttatcttgaagccgctattagtggtctgatggggggggtggccgggtgtctggctggctgggggttagccaaaaccattgggctgatgctattcggtgcgccgatcagtttcgcctggatggtcgtgccttgtgtgctggtgctatcggtattgatagccgtgtttggcacctggttccccgctcgtcgtattactcgcctctacccggtggaggtgctatatggccggtaatcatcataaaggcaatgatggcatgaaaggcaatgatggtatgaaaggcaatgatagtatgttttggcggttggtgctgcgtgcgcttcgtttacgtatgcaacgtgtcagtgtcgtctttgccgcgctgaccgttggcgcggcgattgttaccgcaatgtcggcagtctatttcgatattaatgccaaaatgagtcaggaattacggacattcggcgctaatttttatattggcccaggtcagggtagtacctttgaacagcagacttttcaacccattattgattccgcgccgaaaggtctgattaatgcttccagtccctatatttatggtatggctcgtaccgagctggaaaaagtggttttgatgggcgtctggtttgaatccttgcaacagttagtcccctattggcaggtaaccggcaattggatcggggtcagttttgatgatcgcaatgcgatgatcggtgccaaactggcggaacgtttgcatgtcaatgtaggcgataccctaacattggtgggcgaagggacccgccaacgcttacaaataaaaggtattgttgaagcaggtgacgcgaccgataacatgttgatcgtcaatttggagctggcgcaaaagtggctcaatcaacctgagcggatcagtaatgcattactgagtgtcagcaatgatgttgggcaggtagaaacctttgccagtcatctacgcgaacaatatccagatctggaaattcgcccaattcgcaaagtatctgcctctgaggggcaggttcttgacaagataaaagggttgatggggctggtctcggtggtcatcctcattctctcctctctgtgtgtcaataccacgttgatggcgatagtgggtgaacgttcgaaagagtttgcgttgcaaaaagcactgggtgccagtgggcgtgacattatccgccaaatgttgactgaaacgatgattatttcgctagccgccgcggtctgtggtgctgtgttagggtatttgctggctcaggtcttggggcaggcggtgttcagtgcggcaattacattgcgtgcaccggtattgccgctaaccttggtgctttcgttgtttgttgccgctgtggcggcgattgttcccacccgacgggctattcatattgaacccgctaaagttcttaaaggagagtagcgaatgacctcgtcaatcatagggatgaaacctgaacatctggctgatgccgttattgaaacccgacatttgtataagcgctttggtcaagttacggcactggaagacatcaatattcgtattaaccgtggtgagtttgtggcgattatgggggcatcaggctcgggaaaaacgacattaatgaatatcctgacttgcctggatacggtaagtgaaggccaagtattactcgacggaattgatgccgcaggtttggatgaagagggccgccgacaatttagagccgataagatagggttggtcttccagcaatttcaccttattccttaccttactgccttagaaaatatcatgttggcccagcattatcacagtgtggtcgatgaagaggccgccagacaagtattggaacaagtggggatgacaccacgtatgggccatttacctagccaactatccggtggcgaacagcaacgggtatgtattgcacgggcgttggtgaatcaaccgccgatcatttttgccgatgaaccgaccggcaacctggatgaagagaatgaacagcgagtcttggaattgctaaaccatatccatcgtcaaggccgtactattgtcatggtgacccataatccagatttaggctgtgttgctgaccgggttatccggctgcaacatggtaaatatcttgatgaaaagagccgccatcatgtggcgtaacttgaagatcattggattgtgcagtttattattgctgctcagcgcctgtaagcaggaaaaagtcgcccttggtgaagtggcacctacgctggccgcttacgacttacaaggggaggccgtcgcgcttgagcaatgggaaggcaagctggtctatctcaacttttggtcagtaaattgtggcgggtgtttagctgaaatggcgacattgaatcaattgagtcaggaatatcaggatcaggcagtggtggtcgccattaacactgatcctgagcaagtggagattgccccggtattggcgcagcacaatattaattacccggtcatccgtgatcaattgggtattacacaagaacgttatcaggttataggcaccccaacatcgtttttgattgaccgcaatggcaaggtcattgaatggcatcagggtgtgcgtaatgagcaggaactgaccgctttatttaaacagaaggtgtcagagaaacaatgatgaaaatattgctgttagtggcgagtatgggagtgttcagcgtagccgtacaagctgctgacggtgaacatatctataagcaaacatgctccagttgtcacgggcgttcggcagataggaaaggccttgataaagcaccgccattgatttcattatccagagatgaaattgttgatggcttgacggcgcggcgtgatggcaagattattggccgaggcaataaggccaaagctcatcttagtgatgatgatattcaacagttggctgaccacattcagcatctgaaaaccgcgaaacctaaaactccctaatacacctcgttaaagtattatcctcacaatacttagtgcagtgaacatcaggggacaggccatcaacagcacattttcccttgtatgatttagcgacttcatttgataacgtggatgcggtactatatgttgcatataaaatgcatctttaagttatctaaggaaaatcacgatggaaaacacctctgcacagctagcacccacactgctatgttacaagaaactccctgtctggaaccgtgatggcgtaccggcaatgtttcaggaaaagcacaatacgaaagcgggcacgtgggcaaaactgaccattttggctggagagatggatttcttaattcttgatgaagccggtaataccgtggaaaagcaccagttctcctgcgaacagcaaccaccatttatcgagccacaagtctggcatcgcattgctacctgctcagatgatctgcaatgtcagctcagtttctactgccagccagaagatttttaccataaaaaatataatttaaccccgacccattctgaagtcattgaagcggtaaaaacagttaagccggggaaggcgctggacttggggtgtggctctggacgcaactcgctgtacctgaacctattgggtttcgatgttactgctgtagataaaaataacgacagcattggtaatttacagcagatcattgataaggaagccctgaaagggattactgccagcagctataatattaatgaggccagtctggatgagcgctacgattttattctatcaaccgtggtcttgatgttcctgcaaccagaaagaatcccacatattatcagtaatatgcaggagtgtactttacccggcggctataacctgattatctccgcaatgtcgaccgatgacttcccttgcaccgtacctttctctttcacattccagtcgggtgagttaaaagattattatcaggattgggcgatcctcaagtacaacgaggatgtcgggcaacttcacaagaccgatgcacaaggtaaccggataaaactacgttttgcgactttattggcaaaaaaaatctcataagtacatcactcggtgtagacatcgctggcatcagaatggctttcaggcggctgaaaatcaacatttatgcaacttaatgtcaggcatgtatcaataatagtggtgttgctacatgatatttaaaaacaaaggataatcgcgtgggtaaagaaaaaattgagcatttagaagcagtaagccgtaaagcccgcgtggtcatggagcgtgaggggattgatgcgctggtggtgactgtttgtgacaatttctattatctcacgggttttgccagcttctttatgtataccttccggcataccggtgcggcggttgcgatcatgtttcgtgatgcgaatatcccttcacaaatcatcatgaatgagtttgaggctgccagtacgcattttgatatgccgaatagtgtactgaaaacgtttccggtgtgggttgatgttgatgacccgcgtaatccgcatcatcattataaaaaacgtgatcggcctattggcccaccagtggaagcggtctttagtttagtcaaaaacgcacttgaagatgcgggagtgctggataagacgattgccattgaattacaggcgatgtcaaacggcggtaaaggtgtattagataaagttgcacctgggctgaaattagtcgattcaacggcattgttcaatgaaataagaatgattaaaagcccgtgggaaattgaacacctacgaaaaagtgctgaaatcactgaatatggtattgccagcgcggctaaaaaaatacgggtagggtgtacggcagctgaattgactgctgcatttaaagcggcggtaatgtcgttcccagaaacgaacttttcacgctttaatctgatctcggtgggggacaatttctcaccaaaaataatcgcagatacgacaccggcaaaagtgggggatttgattaagtttgactgcgggatcgatgttgctggctacggtgctgatctggcaagaacgtttgtgctcggtgagccggataaactgacgcagcagatatatgacaccatcagaacgggtcatgagcatatgctatcaatggtggcaccgggggtgaaattaaaagcggtttttgactccacgatggcggtgattaagacgtcaggtttacctcattacaaccggggccatcttgggcacggtgatggtgtgtttctgggccttgaagaagcgccttttgttagcacacaggcaactgaaacgttttgccccggtatggtcttaagccttgaaacgccttattacggcattggggttggctcaattatgttagaagacatgatcttaattactgacagtggctttgagtttttaagcaaactggatcgtgacttacgtcggtatttctaatttattcattgtatcgtagcccggataaaacagattcatctaattttcgctggatctgttttcatcgtgtcgctctgtcagatgcttagattttaaagtggtaataaatagcgagttaaattacgaaagttgtttaatgacttatttcgctagattctttctgtgataattaaaattgtaatgattcgatatatgattataacgtcattgataatctactttgctgaagacttgtcacgtttgattcacgataatcatagaaatgcataaaaaaaattaataatattcagtgctaaaatcgataaatgtcccttgaaatccgttcagtgaacaaattacgctgctcttccagcagaacactgtatcgcagcattcacttagtaaaaatatttactcttatttttttgcatatttaagggatattaatctaggattattcttaattgcattttaattaacgtctttgttacattttcacctccattaatcgctgcaataacaatatcctataatgactctgcaacaataatccctttcagctaacctatatggcatggtgtaatacattctaagaattccatttcatcatcattccataatgaaaaatgtacgttcaggaagtcgctttccttgatcatcaaacaagttgctggcttaagggttatataatgtataacgcatttacaacactactgcgcccgttgcactggcacagaatgactttattagcgctatttatttctggctttgtcgttaatcctgctatggcggatacgcagtatgactcattaattattcgtgccagagccggtgatactgcgccagtcttggactatttacaggaagaatctaaagcgggtccattgcagagtgggcaggttgatgactggctgcaaattgcaggttgggcagggcgcgatcaagaagtgattgatgtttatgaacgatatcaatcttccatgaatatctcttccagaggtttggcttctgccgctcgagcttaccgcaacgaaaagcgctgggatcaggctttggccttgtggcaaagcagcttaaagaaagaccccaccaatcctgatcttatcagcggtatgatcatgactcaggctgatgctggacgcggtggggttgttttaaaacaggcaacagagttagccgagcgtgatcccacggtacaaaattacatgacgctgtcttatttaaaccgggctactgaccgtaattatgatgctttgcaagcctccagcgaagcggtgcgattggcaccaacgtctgaagacgtgctcaaaaatcatctcgaaatcttacagagaaaccgtattgttgagccagcgttacggcttgctaaagagaacccaaatttggtttctgctgagcattatcgccaacttgagcgcgatgctgctgcggaacaagttcggatggcggtgttgccaacgcgcagcgaaaccgagcgttttgacatagcggataaggcgttagcggattatcagaatttattgacccgttggggcaaagatccagaggcacaggctgactaccaacgcgcacgcattgaccgattaggggcgttattggtccgtcatcagacggctgatctgatcaaagagtatgaagcgatggaggctgagggctataaaatgcctgattatgcccgccgttgggcggcttctgcctatattgaccgaaggttgccggaaaaagcagcgcctatcctctccagcctctattattcagacggtaaaaccttccgtaacagcgacgatttgcttgatgccgatgatctttactattcactgaatgaaagcgaacaacttgataaagcctaccaatttgcggtcaattatagcgagcaaacgccgtatcaggttggggtttatggcctgccgggcaaagaaccgaatgatgattggattgaaggccaaacgctattggttcaatcattggtggcattgaatgatctgcccaccgcacaaaaaaaattggaagatttatccagtactgcacccgctaatcagaatttaaggatcgcattagccagtatttatctggcccgggatttaccgcgtaaagcggagcaagaattgaaggccgtggaatcattagcaccacgcagccttattctggaacgtgcgcaggctgaaactgcgatggcgctacaagaatggcatcagatggagttactgactgatgatgtgattagccgttccccagaagatatcccctctcaagaattagatcgccaacgtaaagtccataacatgtatgaactacgggtgagtggtaaccgcgttatctcctccaacagcccggtgagcggcaataaagattatggggtcgaaactctcctttacagcccacctattgcagagaattggcgcgtatttggtggcggcagttataacaatgggcagtttgaagaggggacggggattagccggattctgcgcttaggtggtgaatggacctcccgtgaccattgggttgaaggggaaatttccaatcagaattatggcaatggcaataaagtcggggcccgtttatcaacctggtacgaccttaatgaccactggcgtgtaggggggcaggttgaacgtttagctaaagacacaccactacgggcactgaagaataaagtgaccgcgaatagcgcgtctgcttatgttttctggaaagcagatgataagcgtgatgctgaacttagcgtgacgccgtcgcgtttttctgacggtaacaaccgttgggaatatgaatttaacgggcgtcagcgtatctggactgggccttacctaacggcagattttaatctggggttggcagccagccaaaacagtaaagaagatgtgatttactacaacccgaaacgtgattttgcttacgttccggcagtgactctcaatcacattatgtaccggcggtacaaaaccatctggagccagcaagtccaactgggtgtgggagggtactgggagaaaaattacggtaatggcttggtgaccacggcgggctatggccaacgtgttcaatggaatgatgttatcgataccggtgttgctgtggtttatgacaagcgtccttacgatggtaaacgtgagcacgatgttacgctttctttcgatttaaattatcgtttttaagggaattggaccatggcgaagctattaatttttatcaaatcgctcattgttgggatgatgatcgtgtccactatggggtgtgcggagaagccaacgttcgttccgcctgcacaacgtgcattgccgcaaagtgaaagaccgtggcaaaagaatacatttgttgtgattgcttatcatgacgttgaagacgattcagccgatcaacgctatctgtcggtaagaagcagcgcattaaatgagcagttcgtgtggttgcgtgataacggttaccacgtggtttctgttgatcaaattttggcagcccgtaatggtggccctacattgccggataaggcggtgctcctcacctttgacgatggttacagcagtttttatcggcgcgtttatcccttactgaaagcatacaaatggagtgccgtattagcgccagtgggcacttggattgatactgccaccgataaaaaagtggattttggtggcttgagcactgatcgggatcgttttgccacctggaagcagattactgaaatgtctaaatcagggttggttgaaatcggggcgcatacttacgcttctcactatggtgtgattgctaacccacaggggaataccgaaccggcggcggccaatctgcaatatgatcccaaaacaaaacagtatgaaactgttgaagcctttaagcagcgaatggagaaagacgttgcgttgataactcagcgtattgtccaggcaacagggaaacaaccacgggtttgggtttggccatacggtgcgccgaatggtacggtgctaaatattttacgccagcatggttatcaactcgccatgaccctagatcctggtgtggctaatattaatgacttgatgaatataccgcgcattttaatcagtaataatccgtcactgaaggactttgccctcacggttaccagcgtgcaggaaaaaaatatcatgcgggttgcgcatgttgatttggattatctctacgatccagacccggctcaggaaaaagagaatcttgataagttggttcagcgaatttctgacctacgtgtcactcacgttttcctgcaagcattttctgatccgaagggggatggcaacattcgccaggtttacttcccgaaccgttggatcccgatgcgtcaggatttgtttaaccgggtggtatggcaattggcttcacggcctgatgttgaagtctatgcctggatgccggtattggcgtttgatatggacccgtctttacctcggatcacgcgtattgaccctaaaaccggtaaaacgagtatcgacccagatcaatatcgccgtttgtcaccttttaaccctgaagtaagacagcgcattattgatatctatcgtgatatggcctatagcgcgccgattgacggaattatctatcacgatgatgcggtgatgtctgattttgaagatgcttcccccgatgctatccgggcctatgaaaaagcgggcttccctggttcgattaccacgatacgccaagatccagagatgatgcagcggtggactcgttacaagagtaagtatctgattgattttactaatgagttgacccgcgaagtccgtgatatccgtggcccacaggtaaaatcggcgcgtaatattttcgctatgcctattttagaaccagaaagcgaagcatggtttgcacagaatcttgatgatttcctcgctaactatgattgggtcgcaccaatggccatgccgttaatggagaaagtgccgctatctgaatctaatgaatggttagcggagctagtcaataaagttgcgcaacgccccggtgctttggagaaaaccgtgtttgaactgcaatctaaggactggacccaacctgagggcaataacgccatcagcggcccaatactggcgggatggatgcgccagttgcagttaagtggtgcgcaaagttttggttactacccggataactttattactggcgaaccaccgctaaaagatgtccgccctgtgctgtcttctgcctggtaccctttatatgatcgatagaattattgctttactcatcctatgtctggtgctgagtatccctgcgggaatgattttgctctttaccggcgatgtactgctgaactttgttttcttctatccactttttatgtccggtatttggataaccgggggggtctatttctggctacgccgagagaggcactggccgtggggcgatgatgtacccgcaccagagctgaaaggtcatccgctcgtgtctatcttagtcccttgtttcaatgaggggttgaatgcacgggaaaccattcacgcagcactggcacagacctacaccaatattgaagttattgctattaacgatggctccagtgacgataccgcacaagtcctagatgcgctgcttgctgaagatccacgtttgcgcgtcattcatctggctcataatcagggtaaagcgattgccctgcgtatgggggccgccgccgcccgcagtgaatatctggtctgtatcgatggtgatgccttgttggacaagaatgcggtgccttatctggtcgcgccactgattgcgaatccgcgtactggcgcggtgaccggtaacccacgtattcgtacccgttcgacattgattggccgcgttcaggtcggggagttctcttcgatcattggtttgattaagcggacacagcgagtctacggccaagtgtttaccgtctccggtgtggtcgccgcttttcgccgtagagcactggcggatgttggctactggagcccggatatgatcacggaagatattgatattagttggaaactacagctgaagcactggtcggtattcttcgaaccccgtgggttgtgttggattttgatgcctgaaaccctgcgcggcttgtggaaacagcgtctccgctgggcgcaaggcggtgcggaagtatttttgaaaaatatgttcaaactttggcgctggcgtaaccgccggatgtggctgctgtttctggagtattcgttgtcgatcacttgggcattcacttacctgtttagcatcacattatacctattggggctggttatcactctgccgccgggtattcatgttcaaagtgtcttcccgccagcctttaccgggatggtattggcactgacatgtctattgcaatttgctattagtctggtgatcgaacgccgctatgaacctaaactgggtcattccctgttttggattatctggtatcccatggtttattggatgcttaacttgtttaccacggtggtgtcgttcccgaaagtgatgcttatcaccaagcgtaagcgtgcgcgttgggtaagccctgatcgcggcattgggagggtgaaatcatgagtacgcccctgatttttacggaacagcgtctgctaccgcgctggattgacattatcattacggcgttagcctggtttggttttatcttcctgctggtgcggggctttttggaaatgattagccgagcgccacatatggggccgataccgttgaggatttatattctcagcggtttgacgacgattgcattatatctggcgatagcggcatttaatgccgtcgtactgattatctgggccaaatacaatcaggtccgtttccaggttgaacgccgtggccaccgacccgatctggatgatgatgaattggcaagcagcatggcgctttcacctgagttgatcgcccaactcaaaagtggctcgtgtctcacgttatacaatgatgagcacgggcatttattggatgtgaaagaggggctccaactgccagaagttgctccagtgatccatttacgccagggatgaagcgcgccactctattatgaatccgtaaaagttctggatacttgagtgagtattatcaggtattcaggacgcatttttgttgaatgctatacccagcctgtgccgtcatcagcaaatccattaattatcttaaaaccggttaattatcttaaaatcggttaattatctaaaaccaccttcaattacaatcaccttcaattacaatcacctaaaaacagacgccattacctaaaatctccccatcaccccccccaaattttgaggtattcactccgtcagtgggcttactatctttagaaggaggaagatatttagaaggaggaagaagtcacatgtgctttaagatttatgtttggacacgcagcttattatggcgtattgggtcagatgaatcggggaccgctttgggaagggaagtacccaacgtgtgctgttgtttataataacgtcatatatattgctatgctttttgcagcgttactgttatttctcaataatggatatcacttttcagatgacataaaacgggagcatagcgtgaaacaaaacccatttggacaaacgattggtgcggaattaccgtattggcacttggcccggccccctcagagggagattatacccggtcatttttgttctctggagcctgtgagcgctgataagcacgaagcgtcactgtatcaggcttatcacgcggtgagtgacgggcaggattggacatatttttattgtgaacgtcctgagaataaagatgatttccatcattatctgcaaacattgatccatgcaaatgatgctgttcattatacggcggttgaccctcagttaggccatgcattgggtaccgttggtttacaacgcattgatgaaaaaaacggcgtaattgaaattggttcggttaattggtcaccccgcttaaaacgtaacactgcggggactgaagcaatatatctgctattacactatgccttcgataaattaggttatcgccgctgtgagtggaaatgtgattccttaaatgagtcatcgaatgcagcagcagcccgttttggttttcagtacgaagggcaatttcggcaggctatcgtcactaaaggacgtaatagagacactaactggtatgccattatcgataaagattggccattaattaagcaggcatttaaggactggctgatggccgaaaactttgatagccaaggtaagcaaaaagtgcgcttacaagatctaagaggccgccactcatgatctggaatatcattaacagctaatgctatttatttttttaaaagattaaaaatatttcgcctttacagatgaaaccaagaaaaaaagtaagggcgaaatcattattgtttttcatgcaaggagagggtggggcgttaatagcggagcatcatgttaaaaaggaatgagtgtaaaaaatgagcaagtgaagttattatttttttacactcaaaaatcgcgaaattggccagtgtcattatactgtaatcatctggcggtatttttcacacggtgcaacgtttaggctggtataccttaaaatagttcgaattgtagaaaaacggccacggagtgaatcctcaggcgctgacataagcaagtgaccagggtgaacgaagagatccaatgcagatgcaatttggggtatagcggatagagttatcactgcggggattgctaatggtagagtccgtgattgggctgttaaaacaaaatcaaagattgactcaagcgactcgttgttacgagggcttcctctccggcactcaatttcctacagtacgtttattatctccttttgatattttgtggttgttctctgcgttaatggcgcgtaatactccccttgcgatactgttttcatccaagcccatacccggctttggtgtttattgctatgcgcatttttcattggctattattggctgcaaaggaagccaaaacctcatccgtatgtgaaacataatcgtaccagcaacggctgctacggtaggtgaaacaaacagtaaggtgccacaatgggaagacagaaagcagtgatcaaagctcgtcgtgaagcgaaacgcgtgattagacgtgattcacgtagtcatcgtcaacgtgaggaagaaagcgtgacatcgttagtacaaatggggggtgttgaatccataggtatggcgcgggatagccgtgatacctcggttattcaggcgcgaacggaagctcagggtcattacttatcagccatagaaagtaaacagctcatcttcgccaccggtgaagcagggtgcggtaaaacctatatcagcgctgcaaaagcagcagaagcgttaattcataaagaagttgatcgaatcatcgtcacgcgacctgtgctacaggcagatgaagacctgggttttctgcccggtgatatctctgagaaatttgcgccttatttccgcccggtgtatgacatcttactgcgtcgcctgggctcgtcatttatgcaatattgcttgcgacctgaaatcggtaaagtggagattgcgcctttcgcctatatgcgcgggcgtacctttgaaaatgcggtggtgatcctcgacgaggcacaaaatgtaaccgccagccaaatgaagatgtttctgacccgcctcggtgaaaatgtcacggtcatcgttaatggtgatattacccaatgcgatctgcctagaggcgtgaaatcgggtctcagcgatgcactggagcgttttactgaggatgagatgatcggcatcatccgttttgataaacaggactgtgttcgttcggtactctgtcagcgaacattaaatgcttattcatagcgtatagagcgtataggttataagccaactcgcctgtgaatcaagaatacacaaaaaagggcaagcgttaacagcgcttgccctttgctattcagacggttgctagagcatgatggtcatcatataagcggcaaaaagcgccagatgggcggtaccgttgagaacattggttctgcccgtagagaacgatattttcgacaaaatcagtacgctaaccatcaccacaatatggggtgcttcaagcccgaaattcagttcctgacccgttaacacggcgatcagtgtaacggccggaacggtcagggaaattgtcgctagcactgagccgaagaacaaattcatggcacgctgtacctgatttgccagcaccgctttcaatgcgcccaagccttctggagacaggataagcagggcgatcaggaagcccgtaaatttcgctggggcatttaattcagttaatagggcttccagcgggttggcatcaaatttagtcacggcgatcacggcgatcaaatgtatcaataaccagacggtatgccacaggctgctatgagaagagggtttaccgtggtgtgggtcatcgccctcatcttcatgttcgtatacaaataagctttggtgtgttttagtttgaattgtcagaaatacaccgtacattgctgcggaaatggctgcgacgactaacgattgtgccacggtaaaattgccgccgggcagggtgctgggtaaaaccaacacaattatcgccaacgggaagatagccatcagatattgtttgatacccacgagattaacgtgttgagttgcgaatttacgcccacccagcagcaatgaaaccccaaccaaaccgccaataacaatcataatgatagagtagagagtatcgcgcatcagtgctggtgccgcatcgcccgttgccatcatggctgagatcagactgacctcgagtaccaccaccgacaggctcagaatcaacgacccatagggttcacccaagcggtgtgccagcacgtcagcatgacgcacgacactgaaagcactgctcagaataccaaccaacgcaatcaagttaattataataatggcagcgaaattgctggtattgccccagaagttaagaataactagcgcaagaatcggtagaataagggagtattcttggtggcgagatttagatcggccaggatcatgttgcgacttcatattgagaaggctcctaaaaagctttactgtattaaacgggcattaggcccggttaacgataaataagtgccatattacaggctaagtagtcataagagtaacaaataacaggaaattgtcgcagcaaatttacaagattttaactgaaaaagtaaagggagagagggagagaatggacaggagacggggtgcccattgatttaataaggattagcgtatcctcctctatccaccaaagggtccatggcctcatggcatttttgataataaccctctccattaagatttttcaccagtaagggcgtcgtatactgttattggtgttcactccctttcgctatagcataagtgacggtgtcactacatgatcctttatctgcacctgccagcgtgcccattcacgcgctgtattttcgagtattgtatttattagaacattatatttattagatcattgtatttatttaagtattgtatttatctaagtattgtatttaagtgacgcgtctattgaagtcgcgtgtcgtcgagaaatcagtggttttggcgtgcttcaagatagattatcagtcaaggtcattattctcgggggtaaattgcactcgaacctcagtaccgcctccctctttctgattgatactacagtgcccatgtaaactgttggcgcgatcttgcatgatcatcagaccataatgattgggttgttcactggcttgccctatcccacaaccattatcggttatggacatcaccacatcgccttgttctaagtggacgttaaccgtggcttcgctggcacgggcgtgcttatagatattattcagcgcctcacggacaatatttaccatatgaatggcttgatggtttggtacctgatctggaggtaattgatatttgaaggtaatcgatagaccagctctttcgctgaactcattcaccagagcctgtaacgcggcctccagagtggcttcatttagtttcagacggaatgtggtcagtaactcacgtaattgacggtaggcgatattgagttcatcacgcatttgttttatcaataggttgctgttttccggtaagtccggagtttgcatttgcaaacagctgatctgtatcttcaggcaggaaagggattgagcgattgagtcatgcagttcccgcgcaatagcggaacgctcctccattaacaataactgttgctgatgtctggcttggctctctaacgccagtgtgctggtcagttgctcaactaacatatcgaccagttgctgctggtcagaattgagggggttatcgaggggttgttttgccagtaataaaccatattgaccgagtttatcgcttaaactccaactcagtgattgccataactcagggtggctgatggggcgaacagggccgctgatcgttaatgacgccgggcggtttttaggcatcagatattctgcatccgcattgtgattgacatggtcacgatacagatggttttcatacaaacaaatttgtacattttctagcgtggttaacgcttgtagctgttcaatgacaggggctaaacgctcacttaatggctgatgagtatgcagttggcggctactgtgataaaggaacgccaaaacctgatttttctgttgtaaatcagcggttttatttacgactcgctgctcaagatcgccgtagatcaatgacaattcttgcgacattcgattcaatgccgtacccagcatccccatttcgtcacgctgatagtccagcgtatagcgttggctaaaatcacctcggccaatggcattcgccattgagattaacttcagccaagggcgcagtaaccggcggcgcaaataatagatcattgccaacaataggctgagtgtcagaaggctgaataccagcgggatcagggtaacctgtaacagccgttgttcagttttatggtcaatggctaataccaaagcatcaagttggtgaacaaaatccgccacactggccgccacctcatcagggtgtttggcctgttgtaactgaggcttcagcgtgtcttgccagtaacgttcaatttgctgatattgacccattaacccttcccgcagtagcgcttgttgcaggtcgtgactggttttgtcttgctccaatgccaccagataagataactcattgctatccaaagggatcattgaaagtaacctgtagctctgcatacgcaatgagcctgcttggttgatggcgtgggcattgccctgaatgctttgtgccatccatgatgaaataaccatacccgccagccctagcatgcccagcagtatcatcaacaaagcaatctgattaaccaatggggtcagataacgtttcatcgcgtgggagattcctttgaccaataagcgccgttaccttaccgtttttagcgccgaagtgttagcgctaatggggtttcatacccgcggccgtcatcatcatgcgaaaccgcctggaaacggccaataatgccaacacgctgccacaccagataacgataaaataaatcacgccgagataggctatccggcagatggcgatgtatcgggtggtgagtatttcaggggaaacttggcaggtagttaaccataagttaaagtggctataatagtgaaaattaattgaattttatctataacagatggcttatgacacgatatgaacagctagcgcagcaaatcagagcacaaatacaatcgaaggtctggcaagcgggcgataagctcccttcgctgcgagaaagttgtaaacaatcagggctaagcctgatgaccgtggtgcaatcgtatcagttgttggaaagccaggggtggatcgttgcccgcccacaatcgggctactatgtggcctcacggcccacgcagttaccgcaaccacagcggggtaataagctccatctggatgaacaggttgatatcaatacctttatttttaatgtgttacaggcagggaaagatccggcaatcatgccgttcggttcagcatttccagatccgagtttattgttacaaccgcgtttgtcgcgggcgttggccagcgtcgctcgcaagatctcgccacaaagttctgtaacgaatttgccaccgggtaatgaaagtttacggcgcaatattgcgcaacgttatgctgcctgcgggatgaatgtatcacccgaggaaattgtgattacggcaggggcgatggagtcactgagccttagcttacaagccgtgacacagcccggtgattgggtcgttattgaatcgcccgcgttttatggtgcattacaggcgattgaacgcctacgacttaaggctattgccattacgacggatccccagcaaggtgtggatttggaggcccttgagcaggttatcagccagtatccgataaaagcgtgctggttaatgccccattttcaaaacccaatgggggccaccatgccgtggtcacagaaacagcgactcgtcaccctgctacagcagaaggctatttcactgattgaagatgatgtatatggcgaactgtattttggtgctgaacgcttgctaccggcaaaagcgcttgaccagcatcggcagattttacattgctcctctttttctaaatgcctggcgccggggttccgtgtggggtgggtggcagcaggtgaacatgctcagcgtattcaacatttacagttgatgagcaccgtttcggccagcgtcccgacccaactggcgattgcggattatctgagccaagggggatacgatactcacctgcgccgcttgcgtcgggtaatggaacagcggatgagcacgttgcatcaggccgttgttgaacacttccccaaaaacatcaaaatcagccaccccgctggcggctatttcttatggttagaattggagccaccttttaatgccagtgaactgtaccgacgggcactggagcagggggttagcattgctcctgggagaatgttcaccacagggagtcagtttgatcattgctttcgccttaatgcctcctttgcctggtcagaacaaagcgcaaaagcgattcgtattttggcgaagttaatcggccaattgacgaacgaacgtcgatagccgtagaggctattaatgatcattaatcaacatcaacatcaacatcaacatcaacatcaacatcaacatcaacatcaacatcttcgatctgttgacccagatggcctcttagaatcggggctacacccgcattcctctctgccaatccgtcattttttctccccctccgatgttattacataaatattattacataaccgttattgcataaatggctaatacccactctctattttcactttttaagcagaagaaatgcacttgattgaggcattctctgtacatttgtagtgcaaaaaaaacggaactcgttatttttatgttgcaaaaatgtgatcttgcagagcaaaagtcaaaattattcttagctgcatattatttcgcaataaatacgttaattcgcgcattttatctccttaaatacagtgtgaatgcgaatattttgcataattatgcaatttaactgcctattttaatgggaaatatacaatttattcacattctgagcggtgtggcacgaaagctgctgtacactttatatcaggtgaatatatttcattcgttatggttaacagaataagcgatttttgttggggggcagagattcactctgatgatgagtttctaaacctactatttacgctgattaaagggggcaatatggagcagccaagtcctgtcactcgtcagtcttttgatgaatggctcgtacccacctatgcgccagcagattttatcgtggtaaggggggaagggtcgacattgtgggatcaacaaggtaaatcgtatatcgattttgcgggtggtattgcggtaaatgccttggggcatgggcacccggcagtaagggccgcattgattgagcaggctgataaagtctggcatttgggcaatggctacaccaatgagccggtattacgtctggcgaagcagttgatcgatgcgacctttgcagaaaaagtgtttttctgtaattccggtgcggaggccaatgaggcggcactgaagctggcgcgcaagtatgcgctggataattttgccaataaagcgggtcagcaaggtgagaagaaccaaattgtggcgtttagaaatgcgtttcatggccgcacgctgtttacggtctcagcgggtgggcagcctaaatactcgcaagattttgctcccctgccaggcggtatccatcacggtatttttaatgaccttgcttcagcggaacacctgatcaccgatcaaacctgtgcggttattgtggaacccattcagggtgagggcggcgtgctacctgcggataaagagttcctgcacggtttgcgggcgctgtgcgatcgccataatgcattgctgatttttgatgaaatacaaaccggggtggggcgtaccggagaactctacgcttatatgcactatggggtgtccccagatgtgctgaccagtgccaaagcgttgggaggcggttttcccattggcgcaatgctgactaccacaaaatatgccagtgcgctcagtgtcggtagccatggcacgaccttcggggggaacccgctggcctgtgccgtcgcgggcaccgttctgtcattgattaatcaacctacgctattagccggtgttaaagcacgccaccagtggtttatcgatgaactggctgaaatcaatgcccggcataacgttttcgctgaaatccgcgggcgtggtctgctgatcgggtgtgtgctcaatgcccaatatgcgggcaaatctaaagagattgttcaggccgccgctcaatacgggcttattgccctgattgctggccctgacgttgtacgttttgctccatcgctgattatttcgccgaaggagattaaagaaggcttagctcgactcgccatggggattgaacaggtttgtcaaaaagttacgtcgtaacgtttatgccgtaggcaagggactcgaatatgatgaaagtgcgcccggtagagcgccgcgatctggctgatatctttgaactggccggtaaaacaggcgtaggcatgacctctctaccacaaaatgagcaacatctcgccgctcggatagaacgggcattaaatacctggcaaggctctttggatccgggcgaacaaggctatctgtttgtcttggaagatagcgaacagcagaaagtggttggcgtcagtgccattgaagttgctgttggcctgaacgacccttggtataacttccgcgtagggactctggtgcacgcctccaaagcactcaatgtgtataaatcggtgccgacactgtttttgagcaatgatcacacggggtatagcgaactgtgcacgctgtttctcgatcctgattatcgcaaggataaaaatggcccttttttatcaaaagtgcgttttttgtttattgctgcgtttcgccaatatttctcccgcaaagtgattgcagagatgcgcggttataccgatgagcaaggccgttcacccttttgggagagtgtcggccgtcatttcttttccattgagtttgcgaaagcagattatctcagtggcacagggcagaaagcctttattgctgagttgatgcccaaacacccgttgtatgtggattttctggcggaagaagcccgggcggtcatcggtcaggttcatcctcacaccgcgcctgcccgtgcagtgctggaaaccgaggggctgcaatatcagggttacgtggatatctttgatggtgggccaacattggaagccaacacggatgatgtgcgtgcggtacgcgatagcagcaaacgtactgtcgttatcaaggattatgatatcgaggattacgatatcgatcccaacggtcggctttatctcgtggctaacgaccattatcaccatttccgcgccatattaatgaatactcatctctccgacgaacggctgcgtttaacccccgagagtgccgaggcactgggggttgctgccggtgattcggttcgaatagtgagcctctttgccccggagacaaaacgatgagccagcacgtcatgtttaacgcggtattgtctagccatccggccctgtttatacaaggtgaatggcgcatcggtaacggtgtgtctttcgaaaaacaggatcctatgagtcagcagcggctatggcaggcgcgtgcagcagaccatacggatgtgactctggcctgccatgccgcaagagcggcttttccggcatgggcacgagcttctcttgaacagcgggccacggtgatacagcagtttgcggccttactcgaacagcataaacaatcattagcgcgaactatcagtctggaaaccagcaagccatattgggagacgctaacagaggtgcaggcgatgatcggcaaggtggctatctctttgcaagcctatcaaacccgcaccggccatagccaaaccccaatgggggacagcatgtcagtgctacgtcaccggcctcatggcgtattagctgtctttggcccctataattttccaggccatttgcccaatggtcatattgtcccggccttgctcgcggggaataccgtggtattcaaacccagtgaattgaccccatggaccgcagaagaaaccgtcaaattgtggcaagaggcggggattcctgacggcgtgcttaatttggtgcagggcgggcgtgaaacgggcgaggcattggctgcccagcctgatattgatggcttgttgtttactggcagcgcccataccggctaccacttacatcgtcaactggcgggtcagccggaaaaaatgctggcgctggaaatgggcggtaacaatgcactgatcgttgaacaggtgaaagaccgggatgcggttgtcaatcttgccattcaatctgcctttatttccgccggtcagcgctgtacctgttcacgtcgtttgctggttaaaaccggggctgagggcgatgcttttttactgcgctttaccgccgttgcgcaagcattgcgaattggccgctgggatgagcaaccggccccctttatgggtgccgtcatttcatctcaggcggcagaacggatgttggcggctcagcaacatttgctgttgttagggggggaatcattattaaacatgactcggccagatagccaaagtgcgctactgacaccgggtatcattgatattaccaatatcagcgaggtacctgacgaggagtattttggcccactggtcagtgtgatccgctacacagactttactgaggcgctgaaaatagccaatcagacccgatttggtctggccgtcggcttggtttctgaagatcgccagcaatttgaacaattgttactggaagccagagcagggattgttaactggaacaaaccattgacgggggcttccagtgctgcaccctttggcggtgtcggggcatcgggtaaccatcggcccagcgccttttatgccgcagattattgtgcgtggcccatggcatcactggagtgtgagcacttgacgttacccgcaacattatcccccggtatctcttttgatttgcccaaggtgtgattgaaccgtgtgtggagaaaataatggcaggatatgaagttaacttcgatggattggttgggctaacgcatcattatgcggggttatcctttggcaatgaggcatcaaccacgcatcaaaatcgtacttccaaccctcgtttggcagccaaacaagggttattgaagatgaaagccttggcggatttaggctacaaacaaggggttctcccccctcaggagcggccggccataggcgtattacgcaagctagggttcagtggctcagatgaacaggtcttaagcgatgttgcacgtaacgcgccacgtttactctcggcggtgagttcagcatcctccatgtggacggccaatgctgcaacggtatcaccgtcagctgacagtgctgatgggcgggtccattttaccgttgcgaatttgcataataagtttcatcgggcaattgaagcagagacaaccgcagtattgctacccgcggtgttcaataaccaccgtcattttgttcatcatgatgctttaccttccgtgaccttattgggggatgaaggggcggcgaaccataaccgtttagggggcgagtacgatagcccagcaatccagatgtttgtttatgggcgtcaaggcatggagagcggggcggttcctggccgttatcctgccagacaaacacgtgaagccagccaggcggtggcacggttgcatcagttggaccccaaacgcaccgtgtttgtgcaacaaaacccagccgtgatcgatcaaggcgtctttcacaacgatgtgatcgcagtcagtaaccgcaatgtattattccatcatgagttggcttttctatcgagcacacaggtcatggacgatattcgctgcaagatggcaggcttggaacaacaattagtcaatattgaagtaccagaagccgaagtttccgttgctgatgccgtgtcaacctatctgtttaatagccaattattgcataaggctaatggcaaaatgttgttggttattccgcaggagtcacaagataaccccagtgtatggcggtatttatctgagttggtcagcggcgatgggccgattgatgaactccgtgttttcgatctgcgcgagagtatgcgtaatggcggtggcccggcttgcttacggttgcgggtagtcttgaatgatgctgagctacaggcagttaacagccgagtaatgctgacaccggcactgtttgtcacattgaataattgggtcgatcaacattatcgggaccacctgcagtttaaagatttggcagatccgcacttgttacaagaagggcggcaagcgttggatgagttaacgcgaatcctcaatctggggccggtgtacccgttccagcgcaattagccggtgtggctttagcgaataaccgaacggctcaatgatagaaccaatagaggagcgatgatgctggattttttagcgataaccctatcgggtaaacctccacaagtcatacagggtgaaaccgttaatctgaaatggcaatggctcggtgaggggatattgacactggttccgcaccgcagctacacacaatcggtggtgatctctgccggtatccacggcaatgaaacggcacccattgaaattttgaatcaattagtcaccgatttattagcgggtcaactgccgctgtccgtccgtctgttagtgttattgggaaatccaccggcgatccgcaaagggaagcggtacctcagcaatgacattaaccgtatgtttggtgggcgttatcagcactatacacccagtgacgagacgcgaagggcgagtactctggagcaacgggtgatggcatttttccaggcaagtcacacatcagagcgtttgcattatgatctacacaccgcaattcgggggtcctatcatcctcgctttggtttgttaccctaccagcagaccccttattccgctgctatgtttcgttggttgcgggacatcgaactggatgctttggttatgcacacctccgcaggagggacattcgctcactttagcagtgagcgctgtcaggcagccagttgtacgttggagttaggcaaagcattaccttttggtgagaatcaattatcacaattcagtgcgatcacccaaggattacgctccttagtcagtgatagtgccttgcctgcacgtaagacagagaacatgaagtactaccgggtcgttaaatcactgcttaggcaacaccctgattttaaactacgggtggccgaggatacggtaaatttcacacgcttcgcacaaggcactctacttacagaacaacccaatgataactatcgtgttgaacacccctatgagtggatcttatttccaaatccacatgttgcgttgggattacgggctgggatgatgttggtaaaaatgtgtgaaagtgaattaccgattacatgagcttgttgggggccaataccgatgtgggcggttctctggagttatacccatacaaatagtaataattaatctaatttcaaatgaactgtcttgacggttcgaaaataatgaattattagatgatgctacttgtttttttattcatttggctaatggtttttattgttatttttatctgattttatgtggcgtatgcgaattccctactgattggataaaatattatcggtagcggtaattaatatataaaataaatttattttttgtttttatattgatgtgaaacataattaaatattaacattaatcctctcttgaaatgataacaataaaatcttaatcagcaaaaacaaataattaggatttatttttgcttgttattttaatttaaccatctaatgtaataatctaaattaatatctttaaattattgagtaacattaatcgttataacattaaaatcccgggaataatcaattaatcaattaaataacaatggcttatgttctctgaaattttttattacaattgctttattgcgtgagataacacttattttcattcggtttttaattgagcggcccataatgataatgtttttttgctttgcagatggttcgctatacaacaagacttaattctcacagcaagacttaatcctcatcgtaagattaaacattaacgaattctgaggttaatgttataaaaattaaaaggaagatattaatgaaaaacatcgcgatggctttggcagccacactgggtatcattccagctctttcaagtgcagcggaaatttataataaagatggcaacaagttggatttttatgggcgggttgctgcgaaatacctatttaaaaaacagagcaatgaagatgcaacttatgtgcgtattggtttcaagggtgaaacaaaaataaatagccagctaactggtttcggtcagtgggaatataacatcgcagctaacaacacagaatctcagggtgataagggcaataaaacccgtttgggctttgcgggtctgaagttagctgattacgggtctttcgactatggccgcaactatggtgttgtctatgacgtgctgtcctataccgatatgttgcctgaatttggtggtgattccatggcagcgacggataattacatgacggcccgctctactggcctggcaacctaccgtaacgataatttcttcggacttgtggagggcttaaaagttgccgctcagtatcaggggcgtaacgaagacggtgatgttacccgaaatgaacgttctatccaaaaggccaatggtgatggtttcggtttgtcttttaattatcaaaacattcagggcagcggcgtcagttttgcaggcgcatactcatcatctaatcgtaccgagggccagaaagaattagtgaacagtgctgcgggtgacaaagctcaagcttgggctactgggctaaaatacgatgccaatcaggcctatattgcagcaatgtatggcgaaacactaaacatgacgccgtacaaaagactgatcgcgaacaaaacccaaaacgtagagttggtcgctcaataccagtttgagaatggtatccgcccgtctcttgcctacatacaatctaaaggtaaggatctggcgggggtcggcgatacggatctggtgaaatatgctgaaatcggtgtgacttaccatttcaacaagaacatgtacacctatgttgattataagattaatttattggataacgataagaacccattgggcttgaatacggatgatgttgttgcggtaaacttgacttaccgtttttaagcagtagatctaaagcgttatgaatattggtgttattgccttttttctgtgtcggaaacaggtgaaatagaaagatagaacggcgggggaaaccccgcctttgaggttattggcaaagtgcccgcgacggagagaacaggtagatcgtaaagacaccggcttccctgcataaaaatagctttccctgggggctcgaaccgtatatggacgcgcccaataaaccaagtcttttttcttgaaaatagcgctcaggtattgcagccatataaccggtttctctatgagcgctattggcccgaaccatgatgaaatccgccaagtgagttcctgtcatccgtgaggacctaatgccccagcagctcatccgtggcgcggacactttactcttctgcctatcctcaccgttcaagatcgcgttatcgaggtttgtcagcagcctgaaaggtgggggaatcccgtctttttactgtgagctttaaatcacttcatccggtactcattgtttgagtggtgttgatcagcatgagaacccgctgctcacacctttgccaagtcaaggctgtaacgtcaagtaatcaagtaataggtgtgctatcaacggtaagtttgctcaccccacgtcagcatggttgtgatgaactgctggagcaattgctgtaaatgaatggctcgatcaggccgataagcgtaaggctcggtctccgacatatagtttaactgcgctaattctagttgtaccgcatggtggtggttttgtggtaatccatatgtgcgagtgatatacccgcctttaaaacggccattgagtacgtggctgaatgccgtttgacgctggcagcacgcaatgagctgttcagttaacgaaagtaggcaactggcattgtcgttagtgccgatgttcaaatcaggaagttgcccatcaaataaccgaggaataacggacgcaatagagtgtgcgtctagaaggagtgcatagccaaattgcgcacttaatctggcaagttcttgctgaagccgctgatgataaggctgccagatatgcgttaagtaggattgccgctcatttggtgaaggtgttttacctgcttcaaaacaagcgcgcccatcaaacagtgtttcggggaatagcccggtggtcgcagtagcatagagtggttggtcatcttgcggtcggttaaggtcgaccaccaagcgggaatactggccgattaaaacactggcgcccatctcacgggcaaagtcatagagacgagggatatgccaatctgtatcggataaaggctgtgctgctgctgtcaggccagcttcaactgcgggagtcaggcgtgtacctgcatgtggaatgctaatgagcaaaggtatttttccgccctgaaagtagtaagagtcagttaaattcatgggcgtacttctcctcggaatacgacagtggcaggtaattgccctcctaaccaataagctaactcggctgggtgtgataagggccaatgcacccagttagccaatttccctgtctccaacgtaccttgagtctgttgtacaccaagagcttgagctgcgtggcacgtgacaccagccagtgcttcttctggtgtcatgcggaataacgtgcaagccatattgagcatcaagcgtagtgaaagtaccggagatgtccctgggttggcatcactggccagtgccatggggaccttatactggcggaacagatcaattggggggcattgtgtttcccgcaataagtagtaggcacctggtagtaagactgcgacagtacccgcctttgccatagcctggacatcagattcagtcgcgtactccagatggtctgccgatatcgcatggaatttagcggccagagtcgcgccacggagagcagaaagttgctctgcgtgcagttttacaggtagcccggctttttgtgcggctaaaaatactcgctcaacttgagccggtgaaaaagctaaatgttcgcaaaatgcgtccacggcatcggctaagttttcaactgccacctgaggaataatgctattacatacgacatcaatataatcatcaggctgcccgataaactcgggcggtagcgcatgggcggccaaacaagtcgttttgacgtcaataggcagtaactcccccaatcggcgggccactcgcaacatttttatttcactttcaagattaaggccatagccagacttaatctcaatcgtagtcaccccttcagcaagtaagggcttcagacgaaatagggcttgttccagtagttgctgttcgctagcttggcgtgtggctctgacggttgaaataataccaccgccattagcagcaatttcggcatagctgaccccgttaaggcgttgctcaaattcattgctacgatcaccgccaaacacgagatgggtgtgacagtcaatcaatccgggggtgataagaccaccttcatatacgacctgacgtgcggcatgaataggcggtaattcggcatgtggcccaatccagactatcttatcgccagtgacagcgattgccccttgcggaatcaactgataatttcccccgcgcatcgtaatgatatcggccccgaaccataagctgtcacagtgagttactgataccatttctttcccctttcccttctcatttgacgttgctgcggtgttagctgcactcggcagatttgtcacccgaatcatttactggatgaacgaaatcaacttgtatatacaatcatggacaacctagcctataaattcactatcagcaagatagcgaattcacaattgcgtaacacttcgcagttctcacagagaaacaaaattgttcaggacgtcaccgtaccttgtggggtaaaacgaccatagagctgataacgagggcctggatagagcaattgtgcggcggtgacgatggctttcctataccaagttctacggcggatcaacaagcaaggttcatgttcactcagttccagtagttgtcgctcgattgggcttggcattacggcttcaacaatgtgttcaccttcggtgagcggggcggcttgtgtcaggtagctgtacggggtgatttggttgaaatcctgtttcatataatcgggggcggtacttgggtttacgcaacggttttcaacctgaacggggaaatcattctcatagtgcactatttgtgaatagaacagttgttgacccggttgaatgcctagcgcgatggcttcttcggggcttgcagggcgagcctccagatgcagaacttgactgctatggcggtgaccacgggcggcgatttcatcggcaatattatgaacttcaagtagagcactgtgggctttcgcttcagcaacgaaagtaccaacaccttgcatgcggataaggaaaccttcattggtgagttcacgtagagcacggttgatcgtcatacggctgacccctaactcggtcaccagttcactttctgatggcacgcgttggtggggctgccaggttcctgttctgatctggcgaataatggccaatttaacccgttggtaaattggtgcaggaatgtcgtccattgctgcgctcaattgtaaaaccgttgattgttctgccacggcgttaacctcgtcaaatagaatatttatatgctaagtctacggttgaatttagcgtgtgtatatgtatatacaagtaagcgatttaattaattgacgcagctgcggagcgcgtttgactctgaacaaaaatattgggatatcgctatgccagtttattttaccaagcgtgcttttttacctgatggatgggctgcagacgtgcaaattgcggtagatgagctgggggatatacagcgtatcagcactggcagtagcagcagtggttgtcaggttttatccgggccagtattacctggtatgcctaatctgcactctcatgcttttcagcgcatgatgtcggggctggcagaagttgccggtgatccacaagatagcttttggacttggcgggatctcatgtatcggttggtgcaacaactgacgccggaacaggttggtgttattgcccggcaactttatatcgaaatgctgaaaggcggatatacccaagttgctgaatttcactatttacatcatagccctgatggttccccttacaatgacataggggaaatgacggcccaattgagtcaggcggcacaagacgctgggatcggaatgactttattgccagtgctgtatagctacgcaggatttggtgctcaacccgcacagcaaggccagagccgttttattcaggataccgagagttatctcagacaacagcaggttatccgtcggcagttggctaatcagcctttacaaaatcaggggctatgtttccactcattgcgtgctgttgagttaagtcaaatgcagcagattttacacgtatcggataaacagttaccggtacatattcatatcgctgaacaacagaaagaagttaatgactgcctggcatggtgtggccagcgcccggttgcttggctatatggtcacttaccggtcgatagccgctggtgtcttgtccacgcgacacatttggatacgtcagaattggttatgttagccaatagtcaggctgttgccgggttgtgtccaacgacagaggccaatttgggagatggtattttccccggtgttgactatatacatcatcagggccgttgggggataggttctgatagccatgtttcgctggatgttgtggaggagctacgttggttggaatatgggcaacgcttgcgtgatcaacggcgtaaccgtttgacctgtgagcggcaacccgccgtggcggatctattgtacagccaagcattagccggagggcgtcaggcttgcgggtgtcaaattagccagctagccgtaggctatcgtgccgattggttagtgctcgatggcgatgatccttatattgccgggacaagatcggcatctttgttgaatagatggttatttgcggggggtaaatcgcaaattcgagatgtttatgtggcaggcaaggcggtaatcgtggatagatatcatccattgcaacagcaaactgcgcaagcttttctggctgtactgaaagcctgccaacaggaggtctgatgagttttaccgtttttgattttgccggtctgcccgtcagccgctggcgaaatggtggcggcgaaacccgtgaaattgcgtgttggcctgtcggcggtgatgactttgcatggcgtgccagtatcgcaacgattgagcaggatggtccattctcattttaccctgatattgaccgttccatcaccttacttaccggtgatggcatcgtcttatctagcccagggttaggggtacataaactctcaaatcctttacagacgtttgctttccctggagatgttcccgttaatggccggttattgggggggagcagccaggatttcaatattatgacgcgtcgtggctgctggcaggccacggtaagttccgtaagttcaggtcagcaattacccgcctcctacggaggattgatttatatcgtcaaaggcgagtggcttatctgccatacagaaacacatcagttgaaggctcaacagggttgctggtggctaccaacgataaaagcagggcaattacaaccgcttgccgccgatagccacttgctgtgggtaacgttagtgcctggccgctagagtagtcattatcacaatcgctatggcaatctggcatttgtagtcagtcatgtttttacgataaatcatgctgttatagttaaccttatgttcacaaagtggcattgtgagcatcaaccgaatatggacctcttgttttataatggtttggttttgtagtaatgggcggcagcggggttaatcggtcattgctgtttgcaacaccagataacgggcaatcgcgatcagcgtctcatgagtctcttctagcttgagtagggggtctgcttgatgggtgatttcggttccggctcgtaatccaaatcttttattcttacgggaaaggctctctgaaattagcgtcgcatccaatgcaccattgctgtcaaccattagcacgctgctgctataggcctcccatgatcccagttcatgaagagttgcttgcatcagatgatctttaggaatatcggcagctacaggatacagggattgcatagcttgccagtggctgatgcctttttgtagctggccttgcagacaggaggccagattttgcaccttaccgcaagtaagcaccttcatatacggaacaatggcaactgagcctggtacacagattggtgttagcgttgcaacaacagagaggattgagctggtatgttcagtgatatcttcagtattaattcgtaattcatgatgaagtggcaccgattgagtttggtctgacgacagtacatgtgtatcggttaaaagttgggtgatcagacagccattggctgagacagtcacggcagtctttgagctaaagcccattaattcaaatccttgcatccggaaagcataggagcgtgccgaggtgttatttatgcgcccacgttggtagcttgcgagtaaattaatattatttggcagcggtatctggcgcgataaaatggctttctgatatttaccttgcctgatttcattaacggtttttgctacccgatcacagaaaatagtagggtcagtttggcgtatctgcatttcgatggcgcttctttctacttgtgtctgcaggtggctgtcttgcttatgggcacgttgattattttcatcatattcatcgccaggttgttcataaatagatggctcataaatagatggctcataaatagatggttcacaactagatgatttatagatagatgacttgttgatagagggcgcgttgtcatattggtcactgtcacattgctgcagcatcgtaagcagttggggtaagtgagagggaagcaaactgcgtattatagcgctgccgcgattgagtctatattcatgcagcggaaggaaaatttgcagtagtgcggtaccgggggccgcatgagacgccgggttatggaagagatgaaccaattccaattggctgagaccataagctcgccactctttaatcgggatacttgccagtgcggatgaaatattaccgacgatgtcggaggataaccaaacacgctcttgaaattgttcgccgctaaagctatcgccatgatcattttgctgctggtaacgtatgtgaacataattaggataggcagttatcagtgccgccagcccaataccgaccgagaactcgccgtctttttcatagatagcgtagggttgccattcttcattgtcagtgagtgacgaatatccttctgagccgcttttactgtgagagatattgcgggcaccctcttgataacgctggactaattttgtcgccattgtcagtgggggagcacagatcgtttgttgacactgcacatagtaaagcggttctccagagcagggcatgggcgatgttactccctcagggagaggctctcgggcctgagcagaaaaattttgactatctatcctaccaaaaggggggagtggccaacccgtgatgtgtttgagtcggttgggcagggttccacattgttgttgatagcggcggatatcaggcaatatgagcgctacatgtaacaacggccaacgggataaatgatttttatcccatggctgaggcctcaccatttcggcagtttctatagcttgggtaaatgataatgaggaaggtataacctgaggtgtgtaggtgtaggtgtaggtgtaggtgtaggtgaatagggatggtggtctgttttttctgcgggtcagttctagtggcgtggacttaatgaagaccatgacatcatccttatgtaatagttattttgattaattatttttttctatttattttaatgataatttctatcatcactattattatgttaatccagttagttgtcattagcacaccctttaacaatcttattggaatataatttttggtataaattcattttataacaatgacatattaataattaaatgaatggatgtggggaggacaccctgtaatagggtcttatgctggaatctattttgatttaaggcgtgctctgatttaatgaattgcctgtttcattactgatgtttaactatttttcttgcgtgatatgattttacactctctatttctatgctgtatcaatgtttattgatgccattgagacgtcaggatagtggcggtaggaggaggtgggtgtttgctgaaggaagctagatatattcagatagtttccatgccaataataggggaattgtctgaaatagtgtttcccatctgcacctttaagcaccaaacaggtattctagtcgctcactagcaggtttgaccattttcgttccccaataattaggggccgccaaagggagatttctccccagccacatactggcaattcacgtttcaagcgctaaaaaggtatctatctttccatgtcgacattattaatttcagcacctcatctggcgttcaaaattatcgccacaggggtatcgttaccccctgatagggtggaatcctcgacgttggatcgtaaactcaataagcctgtcggttatgtagaacaacgttctggtgtccggcatcgttatcatgcgacggcagatgctaaccaagctgagttagcggcggcagcactgcatgatgcccttgagcgccatgggatcaatccttcctcaatcgatttattaatatcagcctcggctattgcctaccaggccctaccgtgcacggcggtgcatattctcaaaatagcgggtctggcacctcgcattgctgggtttgatatcaatagcagttgcgtgagctttatttccgcattacaggtggctgcggggctactgaatgccggaacttatcagcgtatcgctattgtttcagccgatctggcatcacgaggtattgactggaatgatgaggagtcttcgctgatcttcggtgatggtgccgcatgtgccattgtggaacgaggagatggccgcagtggcatattagccagtctggttgaaatgtatcctacgggcagtgagttatgtgagattcgggcggggggcacacgatgcaaccctcgctcaggtatggataacgacgatttcttatttcatatgcagggcaagaggctgttccgacaagcctctggtatcattgaagattatttccagcgtctattggaaaaaagtgggctgacattagcggatattgccacggtaattccgcatcaggcgagccatttatcgctggcgcatatgcgcaaacgcttacatgtgccaacagatgtgctggtggatatctatcgagatcatggtaaccaggtggcggcatcgataccaaccgcattgcatgccgccgtgatgagcgggcgcttttcgccgggtaaaccggtgatgcttattggtaccgcagcagggttgacgctggcggggatggttttgctgccatgagagccttacgatcatgaaagtcttagtgacaggggcaaccagtggattggggcgcaacgcagcacaatggctgttggaggcagggcacgaggtctatgctatcgggcgggatcaactggcgggggaagaactgcgcaagttgggtgccacctttatcccgctggatctgaccatgaccacgatggaggtctgccagcaatggctcaaaacgtgcgatgtggtttggcactgtgccgccaaatcagcgccgtggggtaacccacaggattttcaccagaccaatgtggtggtgacgcataaacttgctcaggccgccggtcgcgagggggttaaacggttcattcatatctcatcacctgccgtgtatttcgattttcgccatcatcatgatctgcctgaaacataccgggccagccgcttttccagccactatgccagcagtaaatatgcggcggagcaggtgttgcatgaatgtatcgctcattatccggacaccacgtatgtgatcctgcgcccacgtgggttatttggtccccacgatagggtgattgtgccgcgtttgctgcaacaactgagcagggatcgcaatgtgctgcgtttaccgggaggagggcaagcgcagcttgatctcacgtttgtgttgaatgtggtacatgccatgatgttagccactgataacgacgggctacgctccggtgcgatttataatattaccaatcaggagccacaacggctggtgacgatgttggattctctgttgaatcagcagcttcacattaactataccttgcagccggtgccctactcgttactttctgtcgtggcggcagggatggaactggtcgccagtatgacccagaaagaaccgctgttaacccgttacagtgttggcgcagtctattttgatatgacccttaattcagaacgtgctgttaatgaactgggctaccggcctcgttactcgatggcggaggggattgtgctggctggcgagtggcttagcgcgcagaggagtggccagcatggctaagatcactacgtttgaagtgggctattgcacacaccttgcctgcatggcgcttaaaggcgccccttttcgtgtttgcaagttcccggctcgcgcctgtttgattgaggtagacgaccaccgctggctatgggataccggctatgcaacttggtttgagcagtacacccagtcaggggtttttcgcctctaccggcaagtgacgccagtctatttcgatcccgcgcagtctctggtgacacaactgcgcgaacaaggctatgttaatcgggatatccacgggctgatcttgtctcactttcatgccgaccatattgccgggctgcgtgattttagcgaccttacttttatttgctctggtgacggttggcataaaacccgcgaattgcgtggcgttgcagccctacggcaggcgtttattcctggcctgataccggagaattttgaatcctccctccagtttatcgagagtttcccacagcagatgctaccgtctgaacttgccccctttgagagcggtttcgccttgcccggtagcaaagggcaggtcattctggtgccgctaccgggccatgcggtggggcatattggggcatttattcttacggataatggctgggtcttgctggcaagtgacgcggcctggtcaccgttaagttaccaacaactgcgtgggccatcacgtatcgcgaacttattgatggcagactcgtgtgcttactaccaaacgttacagcggcttaatcaattatggcgcacggggaaaacagacattcggttatgccatgagggggatttatgatcccgtttatgacgctctggcactattttcgtatccgacgcctgcactttgccaaccgtgaaacgcttgaagcttatcaggtcaaaaaacttcagcaattctctcaacaggtattggctaatagcccttggttcagacgctacgcctcacagcccatcacggcgtggccactgatggataagcaactgatgatggaacattttgatgtgatgaacacgcagggtctacaccgtgacgtgctgatggcatgtgcgcttggcagtgagcaagatcgcgatttttcacgtcaaaccgggaagttcagcgttgggttatcatctggcacctcgggccaacgtggtctctttgtggtcagccctcaagaacagcaactctgggcggggggcattctggctaaaatgttgcccgatggcgtattcgcgggtgagcgtgtggcgctatttctgcgggcggataataacctttaccaaagtgttaacaaccgttggttgagtttggcgttctacgatctttttcagccttttcagtctcacgcaggtcttctggaacagcagtcgccgacgattatcgtcgcaccggcacaggtgctacgggcgttagcgttggcggtgatgcgcggagaactgcacctcacggttaaaaaggtgatttctgtcgccgaggtgttggatgaaccagatcgtcaactcctacaacaggtttttggtcacgttggtgaagtctatcaggcgacagaaggcttcttagctgccagttgttcccacggcaccttgcacctgaatgaagaatttctacacattgaaccgcaatgggtcgatgagcggcgctttaccccagttatcaccgattttacgcgacgaacccaacctatcgtgcgttacaaactggatgatgtgctggtagtgagcgataagccctgtccttgtggcaaccctgcgcgggcgattagccatattgaagggcgttgggatgaccagttactgcttcctgacccgcaaggcatattgcaggtgatatttgccgatctctgtagtcgggtattggccaccgcgttaccgctgacggcggattaccgtctgattcagcgtggcgaccatcatctacatttgatggccgattgcacggctagcgaactggaatgttgtcggcgtgcgatggtattgatgcttcagcagcagggtattgagaccgagaggttatgttggcagttagaggcagtggccgtgatcccacaatttgatcgcaaaaggcggcgtattattcgtcagggcgtcgcggggtgaaaacagggctatttctggtccccatcaaggcggttagctggttggtggtattgccctggcatggggagcgggcgttatagcgcagtgggtaaatgggcaccaatccacagatgtcgtcagataaaggtgagcgatgacgaatatattgataacgggcgcatcggggtttattggcggggcatttatgcgccgctttgcctgtcatgacggaattagactctgtggtattgggcggcgctcggtagagggttttcccacgtcagtgcgttatcaggcgctggatttagcccggcttgcaacactggattttacgccagatgtggttattcatgctgccggacgagccgggccatggggaacccgcagtgagtactaccgtgataacgtggtcactacagagcaggtgattaaattctgtcagtccagaggaaacccacggctaatttatctttcgactgccgcggtctattaccgttactgccatcaactggcactcactgaacagtctgaaatcgggcctgaatttgccaatgattatgctctcacgaaacatcagggtgaggcgctgatcgaggcttatcagggagagaaaaccattttgcgtccttgtgccgtatttggccctggagaccaactgcttttccctcccttattagacgcggccagtcgtcacgggcttcctcttttaatttctgaggtgcccgcacgtggggaattaatgcatatcgatgtgctgtgtgattacctgttaaaagccgccattaagccggaactgcgcccgttctataatttatccaatgcagaacccattgaaattaatgaatttcttattgatgtcttgagcaagcttggcctcccagcacctaaaagagaggttcgcgtagccactgcaatgctaatcgccggaatcattgaaggtacatatcggttattgcgtattaaaagtgaaccgtccatcacccggtttggcgttggggttttgggctattcgaaaacattggatgtgagtgcggctatacacgattttggttcgccatcccgttccctttctcaagggctagatgcctttattcgctggtacaaggaacagaaataatgatttacctcgcggccatctggctgggcatcttgttgtttaagctgatttttacgctacgaatgatgaagagagggacgcaggcagggtgtggcgtaccacaagccaccgccacgatattgcaacctgtgttgagcggtgatccacaattggcaaccgtgctggaggcaaacgtcgttgcactaaaacaggcacgttttttttggcttattgacgatgatgatacggtggcaagagagatagccatcagtattcagtcgcgttatcccgacagggaaattaaggcaagctatttcccctcagcgcctgaaggggttaatcctaaagttttcaagctcgaacaggcctggcgggaggtggcgagtgacatcttattggtattggacgacgatgcgtttttgtcagcagagtctttcgggacgctattgaaccagattgaagagggcgcattagtgaccgcgcttccttattattgtgccgatagtaatgggtactcccggctattggcgcaattcgttaatgataattccggtttcacctacctgcccttgttgccgttttcaccccccttaaccatcaatgggatgtgttatgcgatatccgtcaatacgttggctcaagtggggggctttgccgctattctacacgacctggccgatgatctggcgttggcaaccctgctcagacaacatcatattcgtctaatacaatccaccgccccagtaagggttcaaaccagtctttcttctggcaaaaagtatatacaacaaatgcatcgttggtttttgtttgccacgctactgttgcgtgaaaaaacagtgctgataaaactgattatatttctgctacaggggctgcatcctttactcatgtgggcgatgttactcactgttggatgggagtgggtgacggcggcccacggcatcacagggattaacctgggcattattgcggcttgtttgctgatacgccatgctgccctccgtcacgttcagcaggccattgcccctgatatccgttcaaatcctattttttcgctgttatctgaattaatgcaaccgttacatttattacatgcgttgtgtaaccgaacgatttactggcgaacgcggcgctatcgtgttttgagtaataaaaagtttaattcactatgaataagataaccttacagatagcttatattaccggccgtagctcgccagaaagcggtagtttaagcccggttcaattagcctttatcaaaaaattagctcaaccggggcgcgaattggctaccttgaatttcccgtatcgtgctggtgaaaatgagaagaaaggctatttagcgccaggtttaattaaagctagctatcataattgccgcgaatatctttcctcacgccaccctgagtttcaaactcactatcggcccgctttattggctttactggcacgagcgccgcatacggtattgctctctggcagctgtggtttggagttatttaataacttaaatctaccgaaggccatgatgagccatgtcagtatctttgcttatgggccggtagctcggcagcggcctttgtgccaccacacgctggttcaagggcagcgtgatttgatctccagattttggtgtcggcaagtggatagcaaagtcagtggtggccatttgaattatctctctaacccagcattactgacgctttgtgagcgttttattgcggcagttgaatcaactcagggattgcgatgaagacgttagatgatttgatccccccggctacccgctgtatcgatctgctggccccgcctttttctgggcacttacacccgatactggcgttgggccgcatgttggctaaaaattacgaggtacgcatcatcagcacgcaagatgcgttggcgcgtatcacggcggcagagctaaagggcattgctttgccgggtgaatatgacccgctgttacaggcaattgccaacccagactatgcggttaaaagcagtccgctgaagctttatcgccaatttaaatctgcggttgggttactcgtcgagtttgcctcggcactggaaaaactttatcaacatgatggtgcgccagacctggttattgctgactttactttacccgtggtagggacggtgagtaaaaaattgggcatcccttggtggacgagtttaccctcgccctgtgtgctggaaacgttagacggcccaccggcctattgcggtggcctttatccagcgaaaactgctatggataacgtcagtcagtttatcgcgcggaaaaaagtccgttggtttaaaaaaacgcttttttggttattccgtagaacaatctcaacaaccgggatcacggcgttatatcgcgccgatggtacagaaagtgcttattcagcagactgtattctggctctgggtgatgtcgcatttgaatttacccgaacctggccggagagcgtccattttattgggccagcgctctatacaccgcctaatttgcagcctgcgccgcactttgaagcaggtcgccgccatgtgctagtgaccttagggactcatctggcctggcataaagatgaagtggtaaaggcggttgagagacttgcccgaaccatgccagagtcagtttttcatttcactgagggggatccgaatgcggcttgccatcagcagaccgataatttcatccgcttgccgtggatagattatgaaacctgtcttggtcactacgatgtggtgattcatcatggtggtgcaggaattctgtattactgtctgaaacataatataccggcgttggtctatccggttgatttcgatcaatttgaccatgctgcccgccttgatgcgtcggggaaaggtctttggttaaaaggggggctgagcgcgttggcgaatgccaaaactcagattgagcagttaactgcccgttagggataaaaataacgtaaaggggtaggttgccgacaaagtcaaatgaaggcgaaatagtgtgaggcggggcgatttaaccaacgttcggatgatccacaatacgtgattcactggatttttagtaagaaatagccaggttcggttccctggctgcggggttttaaaggctgctggtaagggtacattcggaaaaaagttgaaacagcttactgttctcttctctattcatgacgctaaaactaatgccactatctgatttttcaaatagattaaacgtcttttcctccgcgtccatcattacgtagtctaaatcttttctatcttcatcggtgaattcaacgcccgcttttctggcaaggttttccacttctgcttccgtggcgcgatgtaacaatggtgagatataattacccccgttcatgccatataccgtaaatcggctaccatcccactttatttttgccgtttcagtctcttctgggaaatgatttccacccaagcttttggaggttctatccaattgcttgctcatatgacaagtatagtattcatcgctagcattatttttatctgccgctgaaactgaaactgcaaccatcgcgatgagaataaaatattttttcatggtttaatccttaacttccattgttatttgaatgtatttttatcttttagacaggaatataacttgttacctagtgtctcaaaattttcacttgtcatctttaaaagaaagcagacaacatttaattgcctgctcctcaatattgccagctcctcaataaggttatcttttaggccgccgcattatcatataatttttgaatgagaagctgttgttcctcggtcggctttatcccaagagagtggtagatgatccccaactggtagagttgttgattccctgatgcatcttctgcggtaatggattcacgcgttaacattgatttaagtgtgaacgtgatatgttgcatgcattcaggtgtattggtagcacaaatattttgcaataacgtcaggttttgtccagaaagaccggtatctttcacaacacgcgctctggcttcatcccactgtttattttttataaacagatcggtaataaagtaattttgggcggtggtgacatgcttattaagtattcgttcagcactgacgacatcgcctgcaaaaccatacatttcagcaagatccctataatttctttcgacttctttgggcggagagtcttttagctgtgagagataaataacctctgcatctgcagccaacttcttagcttcggcgatacgtccaatatcaactaattttttaacgatggatttagttaccgtttcccatggattgaatttttgattttgtgattcttcaataataatgtttaaatatttatcagctaatgcatcagatttgcttaaatatagaaaattaagcgaatctattttatattcatagcaatatctatcgtcataacaggcatattctggtgagatcatcagcttatcaatacgctctttaattaggccggtttcgttagtggcattcaacaaccggataagctttatttcttctataggcttgggagcaaagctaaaggacttatctgtagtggcaatgctggttgcaattaatgcattgtattcttcagtgaaaccattagcatggtaaaatgccatgatcccggataatgccaaatcataataggtacctttatctccggccgccctgagtagctgttctgataatattaatgcttgttgcttattacctgcaaatgaatatagattgatcaaattcaagtaatctttataaaaatgaatttcattgttcttcttctttttgagcacgtcgataaacattacctgtgctttatcggtataaataagggtgtttttggggtcaccgttgacacgataattttctgcaatagcaagcagcatccttaattgattggtcggttctattatgttgtcgccataaatatctttataaatagtcaccgcttgatctggcgtatctctataagcgtctaaaacagcgggaagataatagttccttgcactgttatccagcataagtaactttaacgcagattcaggctgtttcttttcaatccaggcatcaacataattcttgtatgctgagaatgagctcggtttctcgagtccaatctgtgataaaaataccattgctttgtctggattacctgttcccgcaatccagtcagcagaaatattcagtgataacattgcctctttcgaactgaaatcaagtttctttaatagcgtattggctcgttctggtgagctaaacatcaggatttctcggtgcagttcgaaataaggggcctgagcatcataatgggggtgttccgccagcggtagggcattttccagttttcgttcaaccactgaatagacatcgggcaatgtctgtgcatgagcgaagctcaagccagagcaaaatgttgcggtatagactaaagttgaaaaaaagtttattttcagtttcatataatcttatccatgatcaattttatgaggtctgattaatccagaccccattattaaaattatttacttgttggattctaatttttttaattcttcataggcttctctcatcccacttttagctgcaacggtaaagtggaattttgccttatccaaatttttctcggtgccgtctccattttgatatatccaaccaaggttataatgggcgtgcacgtttccttgttcggcagcttttatgtgccactgataggcttctggtaagttcttttctaccccttcaccgacgagatacagatagccaatttccacttgagcatcacttagccctaactgcgctgctttgagtaaataggagaaatattgggtttgatcttctttaacgccgtcaccttcattatacatttgagctaaaagaaataacgccttaatatttttatggtctgctgatttttctagccacttaagacctctatcatagtcttgacaagtataatgatacttacccagttcatactgtgcattatcatcactctgtgaggcttttttgcgtatttcaataggattgtatagcgagtcaatacttttattattgatatagcagtgaataatgctaacaccatcggcattatatgtttctccggtgccctgtatttcattattcacataaggggtggttgttaacagtctaccggtacgatcattaaactcttttttgatgccgcttcttatgccttcaacatagggcatttcttcaattaacttccctgtattgatactccatcgtctatccggaccatcttttttatcgttcttatacattgtggtataaagtagttttcctgaatcataatatttatgttcaccctgaagtttgccgtctttatacggtgagagtgatactatttcaccctgttcgttccatttctggctatcaccatctaagatgtcatttttatagctggttgatgtattaagttgtccattatcaaaccactctcttgatacgccatttttgcgaccttcgttatcgtagatttcttcctgtcgcatttttccatttttataccaagtctggctagagagtttttttccttctttatacgttgatttagacactaactgcccttcggggctgtattcctcgttagttccatggtactgatctttattgtttttattataaatagctctaattttacctgattcaaagtagactgtgtatttaccaacgactttgccagcatggtaggttctttcatctttaattttaccatcaggaaaatactcaaagtatttcccttcgagtttattattcaaatagctatggttctctttaatgtttccattgtcgtaataatgagggcactctccatcggctattttgctgtcaataaaatgtcgtttgctttcaatagcaccattttcatggtagataatatactcaccattgatcaagccatttttaaataccaacgtctcagctaattttcctttttcatcataatatgagtcgtatttcccatcctcttttccctctttattataagtgagaatatgttgaatatttccactggagtaataggatttgaaggtagagacgaatttttgtgttttgaatgtttcatcgtcagtataaccttcaaaggccagcagtttgctcggtataagttcttcagtttcttctgatgactcaataaaccacccggccactttccacagctgcttttctttatcaaaggttaatggcatagggatcaccgatgtcgcctggcgtttcaccgtggcctttaagtcttgatttaaccaaagataagattcttttttcatgaattcagcaccgcacagtgcttcagtgcaaacttctatattggtgagcatcggtgtgccaccgcggtcacattgatctattgtcagaaaaaggtaacgttcacttaagatctcaacgagcaaactcttgattttttccgcgtatacttctgacgttaaaccaaatgattctggccggcctgaaagcgtattcttgttacagggggttttggttttaaagtggaaccgatcggccagcagtaatttcatatcactatcaatggccgttttgttaaaatcaatgttatcaattttagcaacaaaggtaatgggtttaggtactgccggagggggttgctttagatatgcaacagacggataagagagtattaagagtgccaccagtttttttttcaatgttaatccttaatttaaacgttcaatccattgccataatattttttatagtcaatttcagggtgaaatgccatttttctaaccaatagtgctaatatattacaagtaaattaatgagtgtcaaaacgtaatttttcagatgttgtggtagtgattgataatattaaaaatattaatctatcggcggtgatgaattcttgaggttacagtagaaatgacagatttccaattaagttacatttctctctattgttttttacatttaacttttgagtgcattttattatttttaatttgtgaagtgggtgcaatattaattaaatggaattatgaatgtacgatggtaacccgtataatagagacagaaaattgagaaatatcttattttatcctcgtgcttcaataagaatagatgacgtcgccttgccgatatccaacacgtaatcatgagatatatcccacagcgttaacatcgattttttagggggatgtttatcccgaagtatggttaatctcactgaagtattgtcacctgttttttatacctatttccctatcactgaaaggaaacagaactatgcaaggacgcgattacattccctgcgatatcgcagagtaccatctgcttgacgttgctgaattacccccgaaggacaaaaatagggcgttatgtgacatgcgttccttccttcgtgaagggcgttatggtgagcttgataaacaactggaaagtgcacttaccgcatcattccttagccgtgatgccgagcagcgttattatcgtggctggatggatatggaaaatacccccgatttacgtagcgtcatttcaatggggccggaaggtttggcacagatcaaagcctggcaacacgactgccctgaatcgaaccatgcctggttggctgaaacgttgtactggcatcattgtgcctggcggtatcgcagctatggctgggcgaagaagaccactgctgcgatgtgggtatgtgcagccgcctgtaatgaaatgatggtgctggcagccctgcaagcattaacactggagccacgccagtggatggccgctgcgctgattatcccggcgattaccgcgtttggcgttccggcctggctggctgtcattattgccaatgagaaggcggattcattgccggttctgggcgaattacgtgactatcagcagtgctatcctgaagaaatggccgccttgatgagttattcaggactgaatgcctatgctcagatattggctcccgatgcgttaccgccaggtttactgcgtaatcaaacagagaaggcacttattggcccgcattattggctgtttgccagcttgcatatccatccaacccagttctatatcttcaccgattacatcccgttccaaatgccccgttggcgcggtttaccgcaggacatgctggacttaattgtttcaccggcttgtgaacatttgagtcttcaggagaaggaccatttacgccatctgatctggtgggatgattttcgtgatgatctcggccataaagtcgccgatctggttgaacgtgagtggcagttgaccgaggtgaaacgcgaagcggaacaggcgttgaatgcaaatgatcgcgctcaggcactacgctggctggccgcgagttactacgtgatggaagatgaaccatccgcctggcactatttacagcaagcggttgcacaagagcctagtcttggcgggtatttacatcatgccgcgttacggcttgctggaaagtttgcccctgaatcacgctggcggcataaccagatttgccataatgcgcagcttatgcattctccccaggcaatggttttacagggctactgtttgttgaccgggctgtttgggtttacacaaaacgaggcgttagggcgtgaatggcttgattatgctttgcagcacgatccaaaagatgcctgggatcaaaccggtttcatcttaaatgaacttaattaccctgacgatgctacgcgtctgttcactcttggggctgaatatggtgcgcgtggcacggcgtcaagcctgggtagcttttatctgtatgcaccatcggagacacgggacattctgcgcgcaatcagctattaccgtcaggttgttgagcaaaacagtacgcttttaagccaaaaagtcatcgccaaatatccgctaatcgataacaccgatccattctcgtatgaagatgaactaaaaagagcctattactcactggcgcgctgttaccaactgctttcatacgaggaaactgatacggtaaaaaccgccgaacttgaggggaaattggttgcatcattaaaagcatcggttgactggggaaacgatgttgctttacccgagttgttagccctgctttcagaacttcataccttgagtgtgactcatcagtatcttgactttctactggagcatggcaacaaaggcagtatattggcgatgacttcactggcaaaaatttacttcaatcgaaaagataaacatatttataactataagcttagcgctcgctggatgtatttcgcactggcgttggcgcctgatgatgaaaaagttaatgaagtctttttttcccgccatgcgcgcaaccgttgggttactcaccgttatgtctggtcgacatcacgcattgccgcacatgaaatcccagggcaggagcatccaatatgctgaccctaatcagtatcaatcgcgaggttctgtccgggtatttttaatacgtaatcggcccataaaatcggtgcgttctgtatggatatccacttgagtgaatgctgacccaatcgcgaaatgtgattaaggtaaaacatattttcattaaaattgaaatgatgttcacaaaatgctatgttcagcgcagtcatgtcaaactatcacattcaatgggcgactgctcattgactaagaggagataacaaaatgaaaatcgcactgatgatggaaaacagtcaggcaggtaaaaacgcgataatccttaaagagctgaatgctgttgcctcggaaaaagcgtatccggtattcaacgttgggatgagcgatgagcaagatcatcatctgacttatatccacctgggcatcatggccagcattttgttgaatgctaaagcggttgattttgtggtgaccggttgtggtacagggcagggcgccatgatgtcattgaatatacatccaggcgttgtatgtggttattgcatcgatccagcagatgctttcctgtttgcacaaattaacaatggtaatgcgttgtcactgccgtttgctaaaggctttggctggggcgcggaacttaacgtgcgctatatctttgaaaaagcgttcactggtgtgaaaggcgaaggctatccacttgatcgtaaagagccacaggtacgtaatgcgggtatcttgaatcaagtgaaagcggcagtcgtgaaagaaaattatctggatacactacgtgctatcgaccctgagttggtgaaaaccgccgttagcggtgcacgtttccagcagtgtttctttgaaaactgtcaggataaagagattgaagcgttcgtgaaacaaatactcgcgtaacgatataatcgaacaaaaggtttcttattgaactgcaccccaattattggataacaccctgatatttggcagtgcagttttttatgctgtgtcacatttactgcatagctaaaattcaatgcatggtgaatatattactcgcggcggcctgttgcggtaaaaagcacgaccatgcctacacgggtaattgcaacatcacggaactgggacgatagcatggcatggagcccatcttccgtatcgtctttgttagaaaaaataccttttgagttatacaccttcatcaatttcttcccaagacgattatgccctgcatcattgcctaatatcgtcgcgccataaagtgtgccacccgtttttaaccccatagcggtattggctatcacttgcactttatcctttagcgcaccagggaggcaatgcagcagatagaacattgaaattgagtcaaaatagccgtggtattgggctgggaacggttcaaaaacatcatgctggatgcattccttgacccgtgttgacccaatgcgattgctggcaacagcaaggctgttggtattgatatccatcagagagatatgagtagtttcaggcagatgtgtcagataaaagccagtccctacgcctatgtccaaatgttcattaccggcatattcagtgaaatgaggtactaaaacgtcgtgagtagggcatttccaagcaaagtgattggacattttcaatacccaccagtcatataacttcagggtaaatggagtatatatttgggaacctattttggttgatttgttcataataatattccgttattatttcgttacagtgcttattaaatcaacctatggggtagagatcaaatagaaaaaacacataaccatatggatttcatgggaaatggctacagcactacgtcaattgaagacgacgttttttgtacatatgacaaaactaaaataaccgcattagcgatattttccggtgctatggttctgattgccgtatcagaatgatgggacagtgttttaacctgacaaggcgatatattacagatgtgaattgattttttgcgtaattcttcgcggatgctgtggataaagccattaagcccccatttagatgctgcgtagcacgcgccttcaggcaaactggagaaaccagcaattgaggatatattcacgattattgggcaggcactggtcttaatataaggtaatacaagatgtgtaagatgaataggggcgagaaggttggtactgatggtatcggtaattctactataggtcatctcttcgagagcagaaaaattaaagacgccggcacaattgatcaatacatccaccccccccatttgctgaacagcatactccactaattcacgacaggctttttcgttggtaagatcgccataccaaaaataagctcttttggacttatcatcgctaagatatctgtcttgtaatttttgggaacgtttacaagcaagaacaagattcatacctgatttatacagtgcatcagcaatggcagaaccaattaatcctgacgcaccggtgagtattattttaaaattacaggacatacttcctcaattcatttttggctattagataaaagccgggtgtgagaagaccgccactcccggcttgagtcactaagttatgtgaagattattggaacaaattattccaatatctacttctaggtcacgtccagtatattaaatgcttaaattaagagtgatgacacccaaacccaagcacacggccggcttcttggcctgataatgttctaggcactgcgcccgccagagccgtatttttgccaaaggttacgagtttgatgctttttactttagtcgcagtatttttagtcataatatgactcctatcttcttgagataaagtaatccgctaactatattagcggggttttggactcatgcatggcatgcttccaatactgtgagaaatcttatttttgatatagaggctttggtctttaaatgcttgttcactaatgctctttatatcactcacattaccttttttttgggcgtgcttaagtaaagcttcataagcgattaatcgtatctcttcgcgatggttacaaagagacactttgtgaaccagctgacgacttttttcattttcaagactcagtaggccgttatataacacattttgaaaagcgtagcgctcatatcttccctttttaattcttgcctctatttttccttccaatgcatctgaatctatctgaaattcgtattgatgcttcgattttattggtcgcactattaaattgagcgatactgataattcatcaggcggatattgagtatgaacatccttactacgaaaataaaacataactgtattcggggaaagaatcttatctccataacaattaagttctacaacttcgttatttacgccactaactttatcgtaatcatagtcatagagccgagttcgatagccacctccaaaaaaattcactgtccaaaagtcaaaattatgatcatgtgcttcttcgtaggaataaggtgtccgatctaattttccctgcaatgggagccacataacaagacgaatagttatgcgttcattactgtaaagaataaaactcggtgcctgtatgtcattctccagctggaattgataagggttctccaactcggtaatgatctgcgaaaaaatctcatctttattagctgcataggctgaaagccatgaacctacttcaaggatttcgctttccacataaatcccatttgccacattggaaattgccgatgagtgactcaaaattcctaataaatcttgtagtgtcagtgatttattcactggcgtaatattatttaggagcattgctagtttctccttgcgccatgtttatctcggcaagtacacgcctgacataatgacttttctctagtgtgagcacatcgcttaatacggtatcatttgcacgtaacattgctacccaagacagggcgcgaacttcatcagctttatgattgtgtgcgatcttttcgatagctttttttgatctcatattcccatgggttgatagcgctgaaaaaattgagcgctgggaagctattttttcaatactgttaaagtggggttttccccaacataaattgctaccttcatctgtagattcaatatcgaaaacagtttgtcgggcagacgcatctggtttattaatgattaaatttaatgaaaccgaaagtgactctggttcgtgttgtatatgcacatctttattagcaaaataatagataacttcattttctcgcagatacatttcccctttataactgagctgggtaagtccatcagtacgttgaatgggctcattgtaatcaaattcgtacagtgatgtgcgataaccagggccgaagaagcctacggtcatcaggtcaaaagcatggtcatgtgcgaccttgtaagaaaagggaatagcgctggcctgatgtccgggtgggatccacagcattagccggattgtataccacggtgttgtataaagaacaaatccttgagcttgcccgtaattttgtgattgaaagtggtctgttttctccaactcttcaatgataatagaaaaaatatgcgccttattggccgctaatgcacgcaactgagtggcaacacaactcattacttcggatgagtagattgaatttctaagcttttcaatagttccactcgtttcaagaaatgacacaaattcattcagtgtgatgagtgtattttctttcacgtccactttgacagccataatatttacacctctgactcttctgctttatttattgcaaggctctgttctgcggcctcaattatttgagcgtcagagtcattcttcaccaaatagtcgagtaactctagagtagattgaggatcaataagtgagaggctttcgaccgcttcccaacgaacaaagtttgcatatgtagactttgccagtttttccaaaacaggcacagcttgagtcgcgttcatggcaccgagcattctcacgtacatctgtatccttgatgcttggaggctggtacaaatagattcaataggttcgagtgagttcttgtcatagacccatgacaaccaaccttttggctcggagtgagcgataaggataaaagcgtcctgtgcggcttcagtatcaaaatcgagaatatatttataggcttcaaagccatagactttacccggcattaatacggtatcttcgagccttatcagtgccgatggcctttgagagagatcttcgcaaacttggcactggtataaaggaatactaactggcgtattcatggggttgataaccagaatatcaaattcgtttgcatacaaagtcgttgacggacttctaccaataagccgcataagtagatgaaaattatgttgcctacttaagtaaacatgatcttctgatagcaattgataatttgaagtaatgtcttttctttccagtagatcatttaatatttcaataatatcatcttttttcaggctttccagaataggcagaatatcaaagaactgcgcattctctttttctaatatttcagaggccttttccttaagcacggataggctgcgaatgctttcttcagagtttggagatgctgcaataacttccgtatgttttattctattgatagaatcaggactagtaactttcgacatgattttctccttagcataaatacattgtttctgagaaacttaacgtatctgctattcataatgtactcagcttattatgtactcagcttatttgtcttttaacagagcccctttagtgttgtgatgacatacgtattatgactttactctgggaagcttgacatgacactgtgttatacattttggtttttagagtcaatatcaaagcggttagttttttatagctatcgtaaaaatatggatcatttgttaaggagatattaattaatgcattaaattgtgatatttattttaatattatgaatattacaggcgtcgttgaataaattagacatcggagtttgagtgagaacgtattctggaatggccgaatgatggtagcgttgccgcaatggttgcagatgttaggccccattcagggataactgttgcgcttctctggtcagcagggaggactagttaaagtggtagcagagaaagcggaatttcccgtgctacctattttggcttaaagaaggtcccaatattatcgtctaaaaaaagcggatgagttaaaaatacaatttcctcatatttataaatatgagcgtgcacttaggataaatgcccgatatgctcaaaataattggcgttgtaggaaggcggcaacgaagtaagtccccaggcgcttacataaataagtacctggggttgttgagcgtagccaacacagatgcagcttaaagtatgacgagtatataagcagtagtggagccgtcaacgaccccactaattttttattactgaagatttttatctttcaggaattttgatacctgatcggcgatttcaacgttattcagatcagaaaaagggaagtgagtattgccttttataccaatttccggcaaatggattactgtcacgtctccgccatgtttattcaccacatcccgccattgacgcgcaacagccaaccgggcacgccaactatcctgtgcaggcaaggccgttggtttgtcagggatattgtcgccgtagataatcaggacagggattttagtcagtgccataaacttctccagaggcaccgattccccttttacggtatcaaaagcattctttgttgggggagggacgtcgccttctggaaagacaaagctgctgccaggttcaaacgcgactatcccttttacattggcgttcttcatcgcggtaaaccagcctgggccgccaccctgagagtgtgtaaacaaaatagccgggccagatttatccactacggctgacatggcatctgaaattacatcgatatcaaagggcccggtgttaggggtcatctgacggtagtactgatttaatgtctctttatcatgggagaactgtacgccatcaaagaaatcgggccatatacccagacggaactggttaaaccataattgctcatcagcaagtggtttgacagttccttccaccatactgcgcccggcattaccccgacgcggttgatcgaccagataggtcgaaaagccacggcgcaagaagatgttctgaaaaccctcgcggccatccggtgtgctttcccatgtccgggaagactgcccggcaccgtgcaacatcacaatgggatatttgtgtgggttctcaggggtctggtaaaacacagaggcgtgatcaccatgatatgtttgacctgttgggtccaatggttttttcggatcaaactgccctggtgtcgtaatgacggccccaccggcggcaaaacttccttgagactggataaccaagggttttgttggttcagcaaatgtagattgggagattaatccaccaaccaacatacaagtggtgaatgttttcagtaaggctttcaaggtcttttccttatgtgatagcggacaactgaatcatagcgagattttcacgaatgaccatgctgctaaaatgaatgcgttaacaggcagaactcatgaacggatatctaatatcaataaaatgtttgagctcaatgtctttcgctaaaccgccattcatgaatatctcggggtagttctgtttcaggcgggaatgcaaaaatggcattttattattgtgggtactggccgtctgtgactttttccatccacgtcacagtgttaccgtccagtgattctgaaacagcaatatgcaccattgactcttttgcggatgcgccatgccagtgtttaacacccggtgggatccacacgacatcaccggttttgatttgctgagcggcgccctcccattcctgtacccagccggtaccagaagaaacaataagtgtctgtccaaggggatgcgtgtgccatgctgttcgtgctccggcttcgaatgagacggtaccgccggaaattcgggctggggcggtgcctttaaaccgtgagtcaacttttgctgtaccggtaaaagattccggtgcaccaatagtcgtaggttgtgaacccgcaggactgacggtcactgccgcctgcgcagcagcaagcgcttgcgtaccgggcagtaaaagcgcagccagtgtgatcaggaaaactttcatatcgattcaatcctttaacgtgagatattctaattaacccattgaagataaaaactatttcccttctttaaatacctcttttgcaatggatatcgccgttactgcctttggccatccagaatagaaggcaagttgggttatagcctcaaccaactcttcttcagtgacaccgttctggcgagccaggcgcagatgagaacgcaattggtcagggcgatccatcgctaccagagcactgaccgtcaccaggctcctgtcacgttttgagagttgcggccgttcccagatatcggcatacaggacatcgtcagtgagttgcgccatcttgggggcgatatcccccatcaattgttgcgcccgagacggttgcttcgtgttatttttcgccgcatcctgcgcgtgagcaatgctagccattgagccggcaaatgtaagagcagtgcaaagcagatactgttgaattttctttttcatcatccatttcctttgttatcggcacgattaaagaggggggattatgtcggtggcgataacgtgattttaccggatgcttcatgtcaccaggctgacggttgcctgacatgtttgtcagaattgcgatgattgatcagtcgcgtaaagcaagaaagaagaagaggagggagatcctcctcttaaacctgtatgcaaaaatacactgtcatagacgttaccctcgctcagccaggccagacttcacataacgactcatttctttttcaacggactcactgtctatatataagggtcagttattgcaagggtcagaccaaaggtattaatcccattctggctactggcaaacacatctccacgatgcattatcgccaccgccctgacgatggagagcccgagtccatggtgtgtgtcactgcgtgcacgggaagaatcaacacgataaaaacgctcaaacaaacggtttagatgttccgccgcaatgggagctccaatgttggctaccgcgatggatgccagattattttctctggagatcgtcactttcacggtagtaccagtaacagcatggcgggcgctgttttctagcagattcgccagtgagcggtggaaaagccgccgatcaatgcgtgcagtgatatctccctcaacatgaatagacaaatttttttcggcaaatgaaggttctacatactccgtggtcttataggtctcttcccgaagagacacgtcggttaactgggttgcgtgctccccagcttgagcatgggagaggaacagcatatcgttaacaatagaggtcattctctcgagttcttccagattggactccagtaaatcttcgagctcatgcgtttcacgtttacgagatagacctaattgcgtttgccccatcagattggtcaacggggttctcagttcatgtgcgacatcagcattaaaactttcaagttgccgccaggcgatttcctgccgttcgagcacgccgttgaatgcgacggccagtttttgcagttcatccggcagagttaaggtatccagacgctgcccgtgatttcctggcgcaaggtgctgggcctgttcgctgagtttattaacagggcgcatacctattctggcaatcacgaaccccagcagtgccacgaataagacgccaatcgcagtaatgacgatcagcgtgcgggtaaattcattcagagtacccatatacggcgtggaatcgatagcgaccacatagcgcagagcggggcgctcaccttgggcaggaatttccgacatcagtagaaatagggagcatgactcgtctgtcgcaccgggtactttgctgaatcctttgcttaacgaagcccaggttacaccacggggtgccgggccgcctacctgaagctgggggtcatcactgaggacccagtattgtacgcggccgccctcagcagcggccaaatcggtgaatttggtcgccaacgtttgccagccgtccagcgtggtacgggagaggatccacggtgccatcagcgactccctgaattgcaattcgttatgcatctgcttttgcaatgaattatgcaaggagcttcgcagtacaataccgagagccgaaactatcagtatggaggccaaggcaaacattagcgccagccgcccagagatagaacgcttaatcatgatcactctctctatttagtctggcgatcggggcgagtttcaaggacataccccatgcctcgcactgtatgcagcagtttgaccgggtagggcgtatctattttcgcccgcaggcgttttatcgccacctcaacgacattagcatcgctgtcaaaattcatgtcccagacctgctctgcaatcatcatttttgacagaatttctccctgatgtctggctaacaggcttaacagggcgaactctttggcggtgagttcaagacgttcaccggctcgcgtgacacgccttgccagcaggtcgagatgtagatcattaatgtgcaattggctgacatctacaccatcactgggacgccgcctcaacaacgcctggatacgcgcaaccagttcaatcagcgaaaaaggcttaggcaaataatcgtcggcaccgtgacgcaggcccttaactcgttcatcaaccgagccacgggcggataacatcagaaccggagtttgtttgctggcgcgtaggccttcgagaacgctgtaaccatccatgccgggcaacatgacatcgagcacaatcgtatcgtaatcatactcaagagccagatataatccgtcgttcccggtggccgccacatcgacggtaaagcccaactcgctgagggcgcgattgatatacgaagatgtcttctcctcatcttctaccaacaatagccgcatgttcgtctctccctttacccgtcagggcaacaaaaatcgcatttcacctatcttagctgttcatgaccaacaccaggctgacattttcctgacatttttgtcaggaaagtatttctttaactgacagaaatgttatctggccgtcatgctgatgtcagcttgcccaccttagactcatctacaagccaaccccgcgcaaattaagagcaagagacgtgtcgggggaatccgtggtttattttggatatagggagaattatttaaatgaaacacaatgcttttaaaatgacatccgtttttaaaacgacatcggtttttaaatctaccttgttagcggcagtgatcagtctttcatctgggggagcaatgtcagccgattataaattaaatccatttacactgacttatgacggcgcgattaccgaaaacgtgaaaggcaaagtcaatattcatcctgttacttataagctaaatggtttggaaatttctgccaacgtatatacccctgcgaattatgatcccgctaaaaaatacccggccgtggtggtggctcaccccaatggtggcgtgaaagagcaggtcgctggcttgtatgctcagcgtttggcggaacaaggctatatcaccattactgcggatgccgcgtatcaaggcgcgagtggcggcttgccccgcaatgtcgacaaacccgcttaccgcattgaagatattcacggcatggcagactttattacccaatatcctggggtggacacggtccgtttaggcctgctgggtatttgcggcggtgggggctactccttgaaagccgggcaaaccgacaagcgcttcagcgcgattgccacgttgagcatgtttgattccggtctggtaagacgcaacggttatcaggactcacaactttccacaatacaagaacgtttaaaacaagcctctgatgcacgagcacaggaagctgctggtggagaggttacttacgttggggatgccaaactgactgatgagcaaattgccaaactgccgtttgacctttatcggcagggttttgagtactacggtaaaacgcatgctcaccccaattcaaccttcagatacaccgccagcagtctgctcgacttaatgagattcgatgcggcaagcaatatggatttaatcgataagccgctactgatgatggcaggcagtaaagccgattccctgtatatgagcgaaacagcgtttaaaggtgctagcaacgcaaaagataaggaactgttcctgattgatggtgcgacccacattgaaacctattggcagccggaatatgtgaatcaggctataggtaaattggctcagttctacgggaaaaatttataaaagagaaacggatactccctctcttttcgtctgtgccaacactggcggatattgcggatagagagcgatatttgtcagccatacctgatgtcacagtcatttctgtggcatctgcacggtacggtttatggcttaacaatgaagaacgttgttaattacggatgactcactttaccccttggcgagcgctatgaataaattacggttcacttcactgacaaaacatctgattttatttctggcggttgctgtcagcagtttgagtttgatagccgaggcagcagacctcaatgcccgacgagtcctgattgtctatttctctcaacctgaggatgtaaaattagagggtgttgatggtgtatcgggtgcgagcatattgcaaaaaaacggtgaagttctaggaagtacccagtatgtagcacagattatccaggaggaaactggcggcgatttattccgcattgaaacggttaaaccctacccgcgtcaacatgaccccttgctgaaatatgcagagcaagaagtgaaagagggagggcgacccgaaatgagagagaaaatacaaaaccttgcggattatgaccagatatttattggctaccccatctggtggtacaaaatgccgatggtgatgtatagcttctttgaacagcatgattttagtggaaaaacccttattccttttaccactcatggcggtagtcgtttctctgactctctgcgtgaaatcaaacgccttcaacccaacgcacaactggtcactcaaggccttgctatctcaagaaatgatgtgacggatgacgatacgccaaaggaaattatcaactggttaaacacattaccgaacatgccgtgatggcaggctactgaatgaaagcaaaatatatatttcaggttgtacaggatatggtgatgatgattattctgttatcactgatggggtttcatctgtggggagaaagtatccatgagtggctgggtatcgctttcttattgattgtcttgctccataacggcctgaacattcactggattagaaaactggctcagggagaatattctgctttccgcattgtgcaagtcaccgtaaatatcatactggcactgttatttttgtttgccattatcagcgggttgatgctttcaaaacacgtattacccgatctgccgattcaccgttcttctgattttgtcagaaagatccatatgaccagtgttcattgggggcaaattttcattgccgtacatttgggcatgcactggaaaatgctggccaattttttctgtaaaatctggcgtatttcgccattttctcttctggcgacacggctgatgcccgctattttcttcagtattgcggtatacggagtgtctgtttttatggggcgtgacttgctgccctatttgcttattcaggtagattttgcattttttgattttgaagaatccacggcttttttctattttgatttcttcgctatcacaattttcttcgcttatctgacacgcgttctgttgtggttattcctgttgtggggtgagaaaggcaaactgcgggcgtgttaactgcccttgctcaccccagtcactgagttatctaattgactggggattggatacctcagctctatttcaggcgcatcagttaattgcctgcctgaccgggccattagacactaagttttttactcatgccgcgtggcgattcgcttaccacctaagatgttatgaaaacaaaaaaactttcacggcttattattgtagtataaacattatttttcggtaaatttaacagactgaacaatcatgttgatgacatcaaaattctggtaaaaaccaaccgtatcaaacaataattgtgttttagcatcataaacaattgccataaaacaggtgccacccgcggcatgaaaaccagtttcttcatcactgacgccacacgtctgcgtagtctgcatccctttccagcctggccctttaattatatcgacagggctaggggcatccattcccgcttcccgcatccagacaccgttatcgttataaaaaatcatactgtctgtcgcctgttccagagtgccatgctgaacacaaatatttaacgtgtattcttcctcagtcacccgttctggctgattgagactgacgcattgcttttcttttttgactgaccaagtgcttggataactgaagctgaaaccattgccctgatataaggctatctgtcgcatctctgctaacggattttctggttctttgagtgatttatctgtacggcaggcacttagaggacgagccgttgctttagtcagattattcatgcgctgtgccgtggggtctgtatccgcagtgatgcaggcacagccataaccatagtttccattcccggtacgaacccattgggcaggactaaatccaggccagtcacctttcgcctgatagccgccttgagtgccgatttcccacatgccatcacgatcagtcagcgtagcattagctggagtcgggttttcaaaccagccacagcgacgttcggcactattggctgcgtgtgaattcgttacagcactaacagaaatcactacagccagtgtaaacagaaaaaagaaacgcatgaaatatccttatatgaaaacaaaaatccacgcaattgcgtggattttatagcatttttcaattctcatgagattcagcgaaaccccatgagacaacaaattttatttagacgttaaataggaagttcatcacatcaccatctttaacaatgtattctttaccttctgaacgcatctttccggcttctttcgcgccttgctcacctttgtaggtgataaaatcatcaaacgcgatagtttgtgcacggataaagcctttctcgaagtcggtatgaatcttacctgcggcctgtggtgccgtggcacccacggggatggtccaggcacggacttctttgacacccgcggtgaagtaggtttgtagattcagtaattcataaccagcacggataacacggttcagccccggctcttcaatgcccagttcggccataaattcagcacgatcttcatcttccatttctgcaatatcagactcaaccgcagcacaaaccgcaacgacaaccgaaccttccgccgccgcaatagcgcgcacctgatccagatacgggttgttttcgaaaccatcttcattgacgttggcaatgtacatagtcggtttcagcgtcagaaaactcaggtagcggatagcggctttatcttcagccgtcagatccaaggcgcgcaacatgcctgcattctctaaatgtggcaggcatttctccagtgcttccagttcagctttagcgtctttatcaccgcctttggcttttttctggacacgatgaatggcacgttcgcaggtttctaaatcggagagggcaagttcggtattgattgtttcgatgtcatccgctggatcaactttcccggcgacatggatgatgttgtcattttcaaaacaacgcaccacgtgaccaattgcttcggtttcacggatattggtcaggaactggttacccaagccttcgcctttggaagccccttttaccagccctgcgatatccacgaattccatggttgttggcaagatacgttgcggcttaacaatctcagccaattggtccagacgcgggtccggcattggcacgacaccggtgttgggctcgatggtgcagaatgggaagttagctgcttcaatacccgcttgtgtcaacgcgttgaacagggtggatttaccgacgttaggcaggcccacaataccgcatttgaatcccatgtttatatcaccttaaataacttaaaaatcaacccgttaagtttagcgaattgatgtaatcaaaatttatgccgccattatacacataatgatgatttatcacgatcatgctctttcgccgcgtgcgtaatggcacgcctcagaggatgactcgataaatgatgttatgcgctggccttaaaagcgtgcaggcggttcattgctttggtcatgccttcattgagtagcacttcagtgcagcggatagactcgtcaatggcatcgtctatcaacgtttgttcgctagcggggggtttacccaaaacaaagccagtgactttgcttttatcaccaggatgaccaataccgatacgtaagcggtaaaaattagggttattacctaatttgttctgaatgtctttcagaccattatggccgccgttgcctcctcccagttttaattttgccatccccggtaaaatatccagctcatcgtgggcgactagaatctcttccggcagaatgcggtaaaaactggccattgccgcgacggctttaccactgagattcataaacgtggcgggtaccaataaacggatatcttggcctgccagatttaaccgtgcggtataaccaaagaatttactctcttctttcagggactgattgtggcgttcagccaataaatctacataccaggctcccgcattatggcgggtttgggcatattctgcgcccggatttgccagcccaacgattaatttaatgctactcacgttgtctttcgctatgactaaaggaatcaaagtgccacagtttacctgtcatggtgcctaataacaaaactcgagtacattttgttcatactggaatacaggagaaggggggattgtagaaaaataattgtatagttgaatgattttccttcggaatcattcaacttcttggctaaatatctggataatgtcagtttttgtcaaaatacatttgccagttgtgatcgctaccgcaacaccatgagtaccaggctgactatactgaatcattaagtgcacacgaataatcgtattatgcaagcagtttaaaacagcgagtttagtagggttattgactggcggcttgaagtggaggtgacatatgaaacgtaagagcgcaacagtactgggtaatatgctgatggggttgggtttagccacaatggttgttggagtaggttattcaatattaaccgaaatctccgaacttggtttacctcaattttttgcccacggtgccatcatgagtatctttgtcggtgcattgctgtggttagccggtgcgcgtatcggtggtcgagaagccgttgctgatcgctattggtgggttaagcactttgataagcgttgtaccaagaatcaacgtcactcatagggatggataattggttgaatcttcaaaaacagaaaacccgttgtcgcacaggcttcaacgggtttttctttatctgcttcaattaagccactgatcaatctcatttggctaaggataccgccgggataccagcaaaaagcaccgccgtgtttagctgcaacctaattgcgtcgcagccgtgtatccataacccgatactgattaatgttcaaacattgcagagatcgactcttcattgctgatacggcggatggcttcagccaacatgccggatagcgtcagagtacgcacgtttttcaatgctttgatttcagcggacaacggaatggtgtcgcaaacaatcacttcatcgataacggaatttctaatgttatcaacagcatttcccgagaagattgggtgagttgcgtacgcaaagacacgcttggcaccacgctctttcaaggcttcagctgctttacacaaggtaccaccggtatcgatcatatcgtcaactaacacgcagtcacggccagcaacgtccccgatgatatgcatcacctgagaaacgttagcgcgtgggcggcgtttgtcgataatcgccatatcggtatcgttcagtagcttggcaatggctctggcacggacgacgccaccaatatctggtgaaacaacaattgggttttccagattctgctgcaacatatcttccagcaggattgggctaccaaaaacgttatctaccggaacgtcaaagaagccttggatctgttcagcgtgaagatccactgtcaatacacggtcaaccccaacacttgagagaaaatcggcaacaactttggcagtgataggcacacgggcagaacgcacacggcgatcctgacgagcgtagccgaagtaaggaattacagctgtaatacgtcctgcggaggcgcgacgcagggcatcaaccatgacaaccagttccatcaggttatcgttcgtgggtgcgcaggtggactggatgatgaaaatatcaccaccgcgtacattttcgttgatttgcacgctcacttcgccgtcgctaaaacgacctactgcggcgtcaccaaggctggtgtacaaacggttggcaatacgttgtgctagttccggggtggcgttaccagcaaaaagcttcatatcaggcacgagaagaacctcaggcatgcgtccagagaagatattgtcatatcagtaatcaggggcgattaatcatactgattgcaatatacatacgggtatttaaagccaaaacacagtgataaccacgatctttcaagttgcaggcgtgcaggatggtctcgttcatctgaatcacttaacggatgtaagctcatcgggactccctcgtttaccgccttcctgcatcttgaaatatattaggtacaaaacagcattatgaaccggctttcaatcaagtgagacaggtattttcagaacccaaggtcagtgaggccattacttcgaccttacataacgctgtaaatcgttatctgcgctcactgctttcaattttccctgagcgtacacgatgcagtggtgaaacatttacaccacgggcgacaaaaccatgtaaccactcaggggcaatacttaacacctgccgggccgatgactccgtgtcgaattctgcaaacacacaagcgccggtaccggtaaggcgtgacggggcgtattctaacagccatgaaagagcctgttcaacctcgcgaaaacgttttcttgcgatcggttcgcaatcatttgcgtatggagtgcttaaaagcgccgccagtgggcggattggcgtatttctttttaattcaggatcagaaaaaataatcggtgttgggatgtttacaccggggtgtatgaccaaataccacttctctacaggctctgctggctgtaatttttcaccaataccctctgcgaaggcggcatggccccgaacaaataccgggacatcagcccctaatgttagtccgagatcggctaattgttcatcagttaaaccacattgccacagtaggttgagtgccaccaagactgtggctgcattagacgaaccgccccccaatccaccgcccatcggtaaacatttatcaatgctgatatcagcaccgcgtggcacgggggtattgccagggtgtttttgcagcatttttgccgcgcggacgatcaggttttgctcattttccacccctgctatgggggttaataagcgaatttggttgtcatcgcgcggttcaatcgtcagttgatcaccataatcaagaaattgaaacagcgtttgtaactgatgatagccgtcggcgcgttgcccggtgatataaagaaacaaattcaattttgccggtgacggccattttgctggtgacggacatataggttgattcgcggtagtcatgttatttgatcgtccagctatccattttcagtttaatccgttgcccatcttgattcagctccaggcggctgggtaaggggggcgtgacctgcgtgttgtattcttgataatcaacaacccatgtcaccccattttgttggtaagtcagtttcttcaggcgatatttatcgtcaagggtaaaattaggggtatcgcccggtaaaccaaggatccattggcgcaggctttccagtgggatggacatgcccgtcaacttttgaatcatctcttgcggatcatcactgacgtagcgcttaccttgattatccgtcagttgtgtcacacccggttggacaaccaactccaactcagtgctgcctaacgggttagtcagtaataaacgataacgctcgggagaggtctgttgccaaaagaatctggcataaactttctgtttatcagacaggtaagcaaatgcgccacgagtttcaaattggccaagttgctgcaactgttgttcatgctgacgccactgtggcgacgtagggctagtcgctggtccctttgatactgggattgtacaagcagccagcagcagagaggctaaaggcagcaggcgataaaaatgtcttttacgcatgggcatatgggtacaaatcctatcagccgtctggttttcacctgcggcaggtttctgatgaggcaacatttaaggcaaaacaacacgttttgattcgttgcaaatagacatctaaggtgctcacgctaacgggctgaaggcagagcgtcaatatcttgttctatattgaacagcagataatcaattattgtgcataatttgggataatactcaggatgatgccgtgcgacttttattgatctcgcgcatcaagtagaatgcgcttcagacgagaatccatactaacaccagtattactcgaagccgttcccatgactctgcttgcattaggcattaatcacaaaaccgcacctgtatcgttacgtgaacgagtgacgttttcaccggaatcgatggatcaggcgctgaatagcttgctccaacagccgttggtgcagggcggtgtcgtgttgtccacgtgcaaccggactgaactgtatctcagtgtggaacagcaagaaaacctacacgaacaattaaccgcctggctgtgtaactatcataaactcagcccggatgacgtgagacaaagcctgtactggcatcatggtaatgacgctgtccgccatttgatgcgggtcgccagtggtttggattcccaagttttgggtgaaccacaaatattaggccaggtgaaaaaagcgtttgctgaatctcagcgcgggcaatctctgtcgagtgaactggaacggttattccagaaatctttttctgtcgccaaacgtgtacgcacagaaactgaaattggagccagtgcggtttcggtcgcttttgctgcctgttctctggctcggcaaattttcgaatcattatcagaactgcatgtattattggtcggggccggtgagacgattgaattggtggcgcgccacctgcgtgaacatcaggtcaaacatatgattattgccaaccgcacccgtgaacgtgcgcaatctctggcaagcgaggtcggtgccgaagtgataacgttgccagaaattgatgctcgtctggcggatgctgatattattatcagttctaccgccagcccgttacctattattggtaagggaatggtcgagcgggcattgaaaacccgtcgtaatcagccaatgttatttattgatattgccgtaccccgtgatatcgaaccggaggtcggtaagttgtcgaacgcctatttatacagtgttgatgatttgcaggcgatcattcagcacaacatggctcagcggcaggctgcggctgttcaggctgaatcgatagtacaacaggaaagcatgaactttatgacctggctgcgggctcagggagcggtagaaacgatccgtgactatcgctctcaagctgagcaggtccgcagtgaaatgaccgctaaagccttggtagccattgagcagggcgctaacgtggaacaggtcattaatgagttggcctataagctgaccaaccgccttattcatgcgcctaccaaatccctccagcaagccgccagcgatggcgatatggagcggttgcaattattacgcgacagccttgggctggatcagcattagtttcctctaattaatagggtttaaaaccacggatgaagtcttctattgttgccaaactggaagcgttacaagagcgccatgaagaagttctggcatatcttggcgatgccagcgttattgccgatcaagaccgtttccgcgcgctatcacgtgaatatgcgcaattgacggatgtcactcgctgttttaaagagtggcgcagcgctcaggatgatatcgaagccgcagaaatgatgctggacgatctcgaaatgcgtgaaatggcacaggaagaactaaaaattgccaaagcgcggagcgaagagctcgagcagcagctacaagtgttgttgttgccaaaagatcctgatgatgaacgtgactgcttcctggagatccgcgcggggactggcggtgatgaagccgctatttttgctggtgatatgttccgtatgtacagccgttatgccgaaacccgccgctggaaagttgaaatcatgagcgccagcgagggtgagcatggcggttataaagaagttattgccaaaatatctggcgatggcgttttcggccagttgaagtttgagtccggtggtcaccgggttcagcgtgtacccgaaaccgagtctcaaggccgcattcacacttccgcctgtaccgttgctgtgatgcccgccatcccagaggctgaactgccagaaatcaacgccggtgacttgcgtatagatacgttccgctcgtcaggtgccggtggtcagcatgttaacaccaccgattcagccatccgtattacacatattcctaccggtatcgtggtggagtgtcaggacgagcgttcgcagcacaaaaacaaagcgaaggcaatgtcagtgttaggcgcgcgtattcgtgctgctgaaatgcaaaaacggcaattggcagaggcatcagagcgccgtaacttgttagggaccggtgatcgttctgaccgtaaccgtacttacaacttcccgcaggggcgcgttactgaccatcgtatcaacctgacgctgtatcggcttgatgaagtgatggaaggtaaactggatatgctcatccagcccattgtgcaggaatatcaagctgaccaactgtctgcattgtcagagcaagactaatgaattatcagcattggctgtcgttggcggcagcccgttttacccacagtgacagccctaagcgtgatgctgaaatcctactgagttttgtgacaggtaaggcccggacctatctgttggcttttggtgaaacggaaataacggcagaacaactactgtggctcgaaacactggcgaaccgtcgggagcaaggtgaacccattgcttatctggttggggagcgcgagttctggtctttaccgctgagtgtttcctctgcaacgcttatcccacggcctgacaccgaatgtctggtggagcaggcgctggcacgtttgccctcaatgccttgtcgtattttggacctggggacgggtactggtgcaattgcgttggcactggccagtgaacggcgtgattgcgcggttatcgccgtagatatcaacgctgatgctgtcgctttggcccgccataatgcaaaaaaactcgcgatagataatgtgtgttttttgcaaggcagttggtttgagccagtgagcgggcgttttgcgcttatcgccagtaaccccccttatattgatgccaatgaccctcatcttaatgaaggcgatgtgcgttatgagccgcatagtgcattggttgcggccgctgaggggatggccgatctggccgcgattgtcagccaggcaccgggctacttggaacccggcggttggctcatgctagagcatggctggcagcaggccaacgcagtgcaagaacggcttaaaaattcgggatttagtgcggtaatgacctgtaaagattatggcaataatgaccgggtgacattggggcaatggtccgtgtaaccacgcgcagctaatagcgctgcaacatcaagtaaaaagagataaaacaaggaatcgatagtcatgtgggttgattacatcgccatgaaatatttgcatttactcaccgtggtgatcagcattactctgtttgtactacgtttcttctggaaatgtcgcggctcagcgatgcttgaaaagcgttgggtaaagataacgccgcacatcaatgatacgctgctgtttatcagtggtattgtgctgatattgattactggattctatccattcagtccgcagggaacatggctgactgagaagctgtttggcgttattatctacatcctgcttggctatgttgcattaggtaagcgaactcgcagccagaatattcgctggtttgcctttatactcgcactgggttgcctgtatctaattgtaaaactggcaacaactaaattaccactgctgatgggatatctatgagtagcattgctgatttcgaatttaataacgcgtccctgtgtgatggggtgttactggttacccaagagattcgacagacttttccgctggctgatgtccgtaacaaactgcagcagcttgttgatgatgcgcgggccgctatgcctgccgaacttaatcaagatcagcaattagaagtgcttatcgatctgttttaccgtcaatggaaatttggcggtgcaagtggtgtctatcgcctgtcagacgccatctggttagataaagtgttagataaacgccaggggacaccggtttctttgggggttatttttctgtatatcgcgcatcaactgggtttgccgctgatgccggttatcttcccaacccagttaattcttcgtgccgattggctagatgaagagatgtggctgattaatccgttgaacggtgaaacgctgaacgagcatgtgcttgaagtgtggatcaagggcaatctggggttgagcgccgagctggaagatgaagatctggaagaggcagagaatacccttattgtacgtaaaatgctcgatacgctgaaagcggcattaatggaagagaagcagatggaactggcattacgtgccagcgaagcggttttggctttcgaccccgatgacccgtatgaaatccgcgaccggggcctgatttatgcgcaattggattgcaaccacattgccatctctgatttaagctactttgtcgagcagtgcccggaagatccgattgctgaaatgataaaaatgcagatccactcaattgagcaacagcgagtgacattgcactgatcttttttatgcgcagcggttttatagggcaatagccctcgtataccataatgcgctgtaattaatctcgatttaccctttataaaggtataagtatgaaacagaaagtggttagcattggcgatatcaacgtagcgaacgacctgcctttcgtgctgtttggtggtatgaatgtgcttgagtcacgcgatctggcgatgcgcatctgcgagcattacgtgacggtgactcaaaagctcggcatcccttacgtatttaaagcctcgttcgacaaagccaaccgttcttcaattcattcttaccgcggcccaggcctggaagaagggatgaaaatctttcaagagctgaagcaacagtttggcgttaaagtgatcaccgatgtgcatgaagccagccaggcacagccagtatctgaagtggttgatgttatccagttgcctgcattcttggcgcgtcaaacagatttggtcgaggcgatggcccgtaccggtgctgtcatcaacgtgaaaaaacctcagttcgttagccccggtcagatgggcaatatcgttgagaaatttaaagaagcgggtaacgaccaggtgatcctctgtgatcgcggcagtaactttggttatgacaatctggtggttgatatgttgggtatcaatgtgatggtacaagcaacaggcggtcacccggttattttcgatgtgactcatgcgttacaatgccgtgacccgtttggcgcggcatctggtggccgtcgtgctcaggtcgctgaactggcccgcgcaggtatggcggttggtttggcagggctatttatcgaagcacatccagagccgaatagcgcgaaatgtgatggtccatcagcactaccactggataagttggagccattcttagtgcagatgaaggctatcgatgatttggtgaagagtttccctgcgctggataccagtaagtaacccccctgcgtccttggcgctacagcgttgttagcggcactcgctcacccgaatcactgacctgacgttcttgtaaccaccgaatggtttttcagttgggttagggcaataaaaaaggcagcgtaggcaactaagctgcctcagactgctgacaaaccccgatgacgcgatctgaaacggtgaggataggcagaggagtgaggataggcagaggagtaaagcgtccgcgccaaggatggcgcggctcgagcctacatggatgtatttacggcgtctttacgatctgcctgttctctccgtcgcgggcactttgtcaataacctcacgcagcgtaggtaactaagctgcctttttgtgcccagaaaacccccagctaggctgggggttcagtaaagctttcagctttgggtcagttataaaaaccccttttgatttgttaaaacagtttgcggtctggcaactgcaaatgttcaacaagaaatcaaaagggggtcccaatgagggatgaaaagagcttagcgcacacccgatggaactgtaaatatcatatagtttttgcgccgaagtaccgaaggcaggtgttctacagggaaaaacgcagagcgattggcagtattttaagaaaactgtgcgaatggaaaaacgtgaatatcctggaagcagaatgctgtgtggatcacatccatatgcttctggagatcccgcccaagatgagtgtctcgggatttatggggtacctgaagggaaagagcagtctgatgctttatgagcagtttggcgatttgaagttcaaataccgtaacagggagttttggtgtcgagggtattacgttgatacggtagggaaaaacacggccaggatacaagaatacataaagcaccaattggaagaggataaaatgggtgagcaactctcgatcccgtatcccggtagcccgtttacgggccgtaagtaatccatagatgcaaatgtcagatcgcgatgcgcctgttagggcgcggctggtaacagagccttataggcgcatatgaaaaacctccggctatgccggaggatatttatttgataatcaaaacacctagttattctgtagtgccgccagtgcttccggtaaagaagcatagaaattcaacttgcctgaaattggcttcaccctggctctggccagcgtcttcagtggctggaaaggaatatctgtgataaccagcagttgctgctctgtcaacgcttcagtaaagcgcaggaaagcattcaagccaccggcatcgagaacgggcacagcatcccattgcaggataatagtgtcataattatcgcaacgggtgagcaactcactgaatatccgttcagcggcagcgaagaacaacgggccgtttactcgcaataccaatgtcttatcattaaccgccgcaggtatctcactcaggcgtgtcatttgcgcaatacgtcgcataaacaacaatgatgccaacacaatcccaaccgttatcgcgatcaccatgtcgaacaatacggtgaggctcatacacagcagcataatgatgatgtcgtccttaggcgcacggcgcagcaggtcaataaccttatgggcttcactcatgttccaggcgacaatcaacagcagggaagccattgcggctaatggcaggtacgacagcatcggtgccagtaccagtaacgccagtagcaccagcaccgcgtggataatcgcggataccggcgaggtggcacctgcgcggacgttagcagcagaacgggcgatggctgccgttgcggtaatcccaccaaagaagggggcgacaatgttgcctagcccttgaccgaccaattcactgtttgaatggtgcttctgcccagtcataccatcaaggacgactgcgcacagcaaggactctatcgcccctaacatagccattgaaaaggcggcgggcagcagtgcagaaagtgtcgcccagttcagcacaaactcttgaccatttgcggcaggtaactgccagggcagcacaaactgcggcagaataggcggaataccttggccctgagtcccatcagccaagagataaccaaagcgtgagccgatagtcgcaacctgttgatcaaacagtgagagcacccccatgactgcagtacccgcgactaatgcaggtaagtgacccggtaactttagtttcagccgtggccaaaggattaataccagcaaggtaaccgtcgcaattaacgtatcactcacattaatcgttggcatggcctgtgcgagggcggtgacttttccaacataattttctggcacggcgaccaggtgtaacccgaagaaatctttcacctgcatggttgcaatggtgatggcaattcctgaggtgaagccgagggtcactgataacggtatatattcgatcaaccgcccaagccgggcaaaccccatacagagcagaaatagaccggataatattgtcgccaagagtaagccggctagaccaaactgttgtgacaccggatacaaaatgaccacaaaggctgcggtagggccggatacgctgtagcgggaaccaccgctgaccgcgatcacgatcccggcgatagccgaagtatacaagccgtattgcggtggcacaccactggcgatcgccaatgccatagccaacgggatggcaataataccgacggtgacaccggcaattatgtctttgaaaagtcgttgaagtgtataagtttctcgccagcaagcgtcaataattgcgctgaacggcctaatgccgttaattccgtgcgttttcatctaaggttcaaaccaaataaggaaaagacaaaataaatggcgggccaatagaggtccgtctcgagtagcatataacaacgatacgccaatttaacaatgaagatctagatgtatatcaaactatgctggaaactgagataactccgatttttcgacgcgatatatatggccagtgctatagctggcaatgaaattcttgatgccaagaaatggaaagttattattattgccatcacggctattttttcggactaaatgcgagaaaccctataaatagtccggatgaagataaatagtcggaatgaggataaatagtctgaaggaagagctaactaagtctttgatggaatatggagtgaatagaccgttttttatgacatggttgggaagagatgtctgataataagattgctcagaagcacgtcttattttattgggaagggataagttatatacccaaaataattcgagtggcaggaaggcagtaagggagatacacattagccgggaactcattcgaacagtattgatgctagcccgcagggtgaacctcagtaatgagactcattaatcctcaggcgcttatttattttaaggttaacgacgcgtcagtgactggagtgaacgacagcagccaacacatgcagcttgaagtatgacgagtctagcgaaggggtaaagtgagttattgcacaaagaagagcaggttaactccgtcggcttagccgattagccgctttgccccataggggacaaccttgataaagaagggggcggtgtaaccaaaaaaaaggccccgactttcgtcagaaccttatttttgaatttggcggtgagagaggggttcgaaccctcgatacgcttacgcgtatacacactttccaggcgtgctccttcagccactcagacacctcaccgtttcgttgcgccgttatagtggtgcaacggggcggtactatagggggcgacggcctcatggtcaagcagtatttagccgtttcaattcatctggttattcctcatgcatatagcgtaagtcacagccaaattaggtgaatttaacgccaatttttggcggtggcgggggagtcagtcatcacataatctgctcctagatccttggcgagctgataatcctcagcagaatttataccaatgagcagaatcttgctgttactgtttttcttaaaacagtccatggcttgctgattccagacgagttgtgcgcgcgaagcccctttgccgagggtaaatttttcaacgactttcacctcacgccttaattcaaatgcatgatattgcgttttatctcgtttagcggagattttacagtcgtttgccatgaccgcgttggtcagtatttttcgtgtcacatgacggttttcaaatttattaatgctatcaggtaaagcatccaaatactttctgtccgtggaatagagagtgaccttatcaagcaggttattactggtgatcagcgttgataatatatttgccatgatgacgggatcggcgtcgggtgatttgatgtcgaggatgaagtggtttttggggaatcgggtgaagacatcttgcaacgaaggaattttcatccctcgcccacggtaaaaatactggccttcggtcttaaaaaaatgagcagcatctagcatttttatttccaataaagagtgttctgaaataaggccctcactattagtaaggcttttaagatcactagggcggtacagcaccggaataccgtcgcgagtaagttggatggaaagccaaataacatccgcctgattctttattgccatactaatggcatgcaccgtattttctggataatctgcagtgccagctctgtgtgccacaatcagtggggaggcagtggctgaggtgaagtaaacagtgaataatagagaaataagataattttttttatttttcatcccatgctccttattaatatatccaactttaaatatatttaatgttgtagcatggaaatagggtacgggctgccatcaaataaataggagggtattcaagagttaatagcgtgatgttcacacctgatataagcaacaccagtgcctatgcgttcgacgacgagcctggccattcgctgatacagtcgccgtttcgtcgaacaatacagcgactgtacccgccagggaaacagaacaaaaaatatcagcaaatttcctaaccatgaaccttctgcgttctgcctttttgtgtcgccagatttatcgtgtcattacctgacgagcaaactcttttttcatctgcatactgtacgccttaccgtaaaactgaacgggtgtgtcaggctgttttacatcagcattcagttgcttgttcattggggtggaaccgaacgcctcgttcagcgctttctgggtatctgcctgaatcagccagtttaggaacactctggaggccgccggatgcgggctgttggctgcgatactggcaatattgccaccgccgggcataccaaactcaggcacatagaatttcaacctagaggtgattgcgccggtcttttgtaagccggagaggtggtcttcccaggcaggtgtcagcatcagttcgccatcgttgaggcgtgtcaggctatcggcaccggacgccgtgcgggtaatattgttattattggacgcaaaccactgccaacctttctgccagttttttattaccgttgggtcaacagtgtcagactcgctgctaaagtcgccgctcagcgtggtgacgatgcgttggataaaggcttcccccgcccccccgttgttcggatcgttataaccgaaccgcttcggattggcgtcgataaaacgttggagttcctccatggtctgtggcaatggtcgatcacccatctgttggggatcgtaggcaaaaccggtctggttgccccagaatgctacggcgtaaccttgggtatcgacgttctgtaactggtgatacgcatcctgataacccggtaaatcatccactttagccagtgatttcgcgcccatcgtgatcggtaattgtgcgatagagagggcaatgacatcgatcttcccttgctcccggcgtgtctctgccagcaatttgttcatattgccgtcaatgctgccttctggaatacgcaccttgatgtcgtacttttgttcaaaatttttcacaaaactgcgccactgtggttgtagataccaaacgttaaaagtcacgctgccttctttttttgcctgcgcaaccacagagtcccagtcgctggtctgggctgcgagtgttagcgaactgaataacagcccgctcattagcgttatcagtgtttttttcatgtgattatctcctgtaaaatcaggctttcccggtggactgtgacagataattacccttcaaaagcttctcaatgatgatcatcaaaatgacattggggatcaccagaatcattgataccaccgctgcatctgggcggacaaaggagtagccgaggaaggaataaagaatggtcggaacggtaataaaatctggtgcgccaaggacataagcgatgctgaattcttctagacttttcaccaagcagaaaatcagcgctgccaaaaaactcggttttagcattggcaggtaggcgttgcagaaggtgccccatatgccagcacccagatcgcggctggcatcgatcagatcctgcggtaccgccttaaaccccgcggacataatgcggatggagtagggtagcgtcagcacggtatggcccaacacgatgctgaaaaacgggttgctgatattgaggttcattagcatggcgctgaagaagatgccgataatcattcccggcatcactagcgggatcagggttagcatctcggccactgccttgccgcgaaagctcatgcgcccgaaggcatacgcggtaggtagcgatagcagtaggctggtggctgccaccacgggcgcgatggtgtaactgttaatcagtgcttcggaaagtgaggttttttcccagaccagcagccagcggttaaatgacagcacctgtgggaaaatatctggatagctccagggatactgagggtcaaccagtgaccagaggatcgccataccgaacggtagccccagccacagtagattggcaatggcgaaaaaaaccagcgaaatcgtgaccaccaggcggccattggtggtgcggctcatttgacgtctcctttacgggtggcgaacggtgtgattaaagtggcaatcagcagcgtaaaaatagccgcggtggtcataataatgacggcgatcacggcagcgttattccactcaccgtattccatagcggtggcttgcatcaggcgtgccagagaatatgtgttgcgcggcccggcgaccgagaaaaaggcgaaatcgcccagtgcaccgataaagaccagaatgagcgtcacctgcacggcaggtaatgtgagtggtaccacgataccggtaaagctccgtaggcggttggccccgaggttgctggcggcgtccagcacatcgttgcggatggcattaaccgcaccgcccaccagaatcagggcaaacggcaggttcttccagacttgcagaataacaacgccccaaccgaagtcatcgttttgcattcgcagcggttcgttgataacccccagtgccattaacaactcgttaatcacaccgtggtaggcgatgatattgacgaacaaaaatgcggctaccatgccgggaataaacatcggtgcgcgtagcacggcgataataccttctttagcgatcagcggcttgcgtagccataacgccagcggatacgcgaagattaccgaaccaaacgcgcccagcaccgaaacttttaccgagtagaatagggcgctatgcagcacctcgtcctgcaacatgttacgccagaactccagcgaaaaatggctttccccttcaaggttgaagtaaccgaggctctgcaccaccacgacataaaaggtggaacccatcaataacagaatggtgcccaggccactcaacatcagcgaccaggcaagcagatcgttgcgccagcttttcatgataccggctccaaaaagtgaatagcgttctccggcaggcggaaacacgcccgcccgccaagtgccaccggaggttttttaatcagttgcagacgtaccgacagccccgcatcattatggccccaggcctcagtgagattgcccataaacgccattttttcgagtgtcagggtaaagtggttgtcgccgctctgatgagggccgacaaattgcacatcttccggccgccagcagatatagcagtgctctgcacgcggcggagtggttgaatggacgtaaaattcgcccatggcgcagcgtactcgccaagagccgggttgctctgcagcagtaatatgagctgtgtcgatattggccgcgccgatgaaatccgccacaaagcggctggtcgggcggtagtaaatctcctcaggtgccccgatttgctccacattacctgcgttgagcaccacgattttgtccgacatcgccagcgcttctgcctgatcatgggtgacgtaaatagaggtgagatggtactgacgttgcagttctttaatctcaaaacgcacgctttcgcgcagtttagcatcaagattagagagcggttcatcaaacaggatcacgtctgggcgggtgatcatcgctcgggccagtgccacgcgctgctgctggccgccggagagttgggcgggcattttcaggcgttggctttctagccccacctgctcattgatagcgacttttttctgcttcaacccgaaacagatgttatgcgacacgttgagatgcgggaacaaggcgtaggactggaagcacatggcggtattacgtttatctggcggtaggctgttgaccgatttccccccaatcaggatctgcccgctatccggctggtgaaagccaccgatcatcttcagcagtgtcgttttgccgcagccacttggccctagcaacgtcacgaactcgccttcttcagcgcagaaagatatttccctggcggcgtagaaatcgccaaatgttttggtcacctgctccagtaccagtttcgacatatgctttttttccatcgtaggaagatgaatattaaatttacatactaaacattaaactaatgtgacagagatcattaaagtcaaaactgaggtgacaaataaaaataacatgataaaaaacaattaattgacttttttgtgtaaaaatcgctttatcatttaaatttaaatagtaaatttaataatcatgatatcaataaggggcattacataatggcgtttaattttcaccaagcggaaaaggggatcgtgctagccaatagtcaccggggttattccagttgccgaccggagaacaccttccctgcttttgaagcagcccggctggcggggacacactgtattgaaatcgatattcatctcaccgcggataaccagttggtggtgacacatgaccaccgcgttgatcgcgtctccaccgggcagggtttcgttgagcaattgacctatccgcaactgctggaattcgattttggcatgaaatatcacccggatttcgccgggacgcgcataccactgctggccgatgtgctgcgatgggcggtgaaaaacgggatggggctgattgttgaggccaagcagcgccgccgccacgatgagtttgttgcagcaatggtcgcgatgctgcgtgagctgccggaagcgatttcccatatccagatgctgggatttaaccatgctctgatcaaccgggtgaaggcacacattccagagttggcgctacaggtagtcacgttggaacgctacaataaccaactggtggtggtacaacagtcgaacgcaagctgtgtgtgctttgagtatgaatttgcccatatagacgatcttcgcgcttacaaaaaggcgggtctaggggtgcggatgtacttgcatgaagtgaaaaatggtctggatccgctgacgcaataccagtacaaattcgggtatgatagtcgcccggagatcctaagctggctgcgtgaagggctgatcgacatgcttagccacgatgatattccatatcttcaggcgctaattgaagaagcgggtctgcgctgggattaatattaaggacaccatgaatatccgacctgaacggcttgaactgcgcggatcacagcgcttactgctggaactgatccgccgtcatgcgcccgtcacacgtgcggagttagcgcgcttgtcgaacctgaccgcgggcgcgatcacccaacagtgccgggaattaatctttgccggtttggtggtggaaggggaacgcaataccgggcagcgtggtcagccatcgctgccgttgcgtctcaaccctggtggtggttgcgctattggtttgtcgttcagccccggttttatcgatatgaccgtggtcgatctcagtggccgccagttattatcggttgccgagcctcatcaggaaaatcagccgctgactgcgacgctttgccaaatcaaaacgctggtcgaacagacgctgaagaaacgccagctacagcacgcacgtattatcggcattggctatgcggtaccaggttttcttaaggctgatgggcacaaacgccattgtgtgccgtggctgcatacttggcgagaagcggacctccagcaggtgtttgccgataatctgccgtggcctacccgggtggagaacaatgccaatgcttcagctatcggcgaactgtacagcggcgagtggaacaactacagcgatctgacttttatcgaccttggctatggcatcggcgcgggtgtgatctctgggcataagttgttgcgcggtggttttttcaatgctggggaagtcggcatggcgttcccttcaggtacaccgcgtccgtcatataaagatttactggctacgctggagcgtgagggatttagcgaaacgcaactgccagtgctgagcgctgggcggcatccggtgttggaaaagtggtttgaacgctgctgtgatcaagtgcaacaaacggtgtttggttgtgtgcaatgggttgacccacaactgattgtactggggggggctatgccgaagcccatcatcagccgccttgtgcaggaaataagccaacgcctgaatacctgcctggatcctgagcgtccaaaagtaaccttagccgcttcgtcaatgggggcggaaagcgcttcacgtggcgcggcgatgatccctctgtatcaggtgattaatgaggattaagggggagatatacggccctaaaaattctgtgaagctgaaggattggacacaatacgattagagcctgtaagtgactgatgcaagcaacctactggtataaaaaatttattgatataaaacagtgattgatacaaaccagttttgatacgaactagtttttgatataaaccagtttttgatataaataagtgactaacgcaaataattcattgatgcaaaagaaaaaccccaaccataaaggtcggggtttattatttggcggtgagggaggggttcgaaccctcgatacgcttacgcgtatacacactttccaggcgtgctccttcagccactcagacacctcaccgtgtttactgctgtcaacccgattaaacgttgtcgaccggcgtaatgtaggcaaaagtctctccagcgtcaaccctcttctgaatgctttatcactgtttagctaaagttatagcaatttgctgatttcatcggcatttattgagggatacataggctgtcgggcaaggcatggcttttggcactgctgatgagaagaattcctgctatcattagcggactatattttatctgccagaaaccaacctgcaaaaagccatttcgccttgaaagatgttgtggagtagttatgtatcctgttgatttgcatatgcataccgttgccagtacccatgcttacagtaccctacacgattatatcgccgaagctaaactgaagaatatcaaactgttcgcgattacggaccatggccctgatatggctgatgcgcctcattactggcattttatgaatatgcgcgtatggccacggttggttgatggtgttggtattttgcggggtattgaagccaatattaagaatctggacggagatatcgattgtactggcccgatgcttgatgcagtcgatttgctgattgcgggtttccatgaacccgtgtttccgccgcaagataaagccgccaacacgcaggcgatgatcgccacgatggctcaggggaatgtgcatattattagccaccctggtaatcctaagtaccccgttgatatcccggcgattgcacaagcggcggcaaaatataatgtcgcgttggaattaaataactcatcgtttgcgcattcacgcaaggggagtgaggcgaattgccgtgctattgccgccgccgttcgtgatgccggaggctggttggcattgggttcagactcgcatattgcctacgctctgggaattttcgagcactgtgagcgtattattgccgaagtgaattttccacaagagcgcattctgaatgtcagcccgcgccgcttactggattatctggagcagcgtggtcgcccagcgatccccgagctagcagagctgtaagtcatattaaaacaccgaagaaataggatgatgtaaatgaatgatttttcgctgatgtgtcggatcctcggatcactgttttatcgtcagccgcaagacccgctgttagcgccactgtttaccctgatcgaacaaggtaaattggaacagcattggccgctagagcaaggggagctactggcccgtttacagcaagattatcaaccagatgcgttggttgcggattataccgcgctgttcgttgggccagagtgcagtgtttcaccttatgcctctgattatgatgacgcgatgccggaagcggagctcagggctttcctgcaacagcgcggtatgccattaggtgatggcccagcagaccattttggcgggttattgctggcagcgtcatggttagaagatcaggccgcagaagatgaaattgccgcgcaaatcaccttgtttaccgactatttattgccatggtgtgggcgttttctagggaaagtagaagcccatgcgacgaccggtttttatcgcacgctagcacagttgagtcgcgaagctctacaggctatgtgggatgaattatctgaagaaaatccccttcgtccttgacgccgtagcagcgttagcggcactcacttacccgaatcactgactaatgtcagttcatcgggatgctttcgtttgctgccttgctacaacgccaatgactttggggattcctcttttggcgtgacgccgcagcgctggttgcttcaatttgcgttagcggtactcacttacccgaatcactgactggttttgggtcataaaatgaatagattcatcgggatgcattcgcttgctgttttgttgcaagcgaatgattttgggtagatgggcctgtagcgtgaaatgacctgcgtcggttagtcagtcaatgggatgactaattggcccggtttaacttctaaccctttcgccagttttttcgccatggcttccgccttactcttttcgccatccagcacataagccggttgctgattaaaatacgatttcagcgattggttcaggtaaggtgtcaacgccttcatcacggagtccatcttctctggcttgacagtataatcagttaactccatatctttcaggtaaatagcccctttctcacgatcaaaggttggctgtgcttttaatgtcagcgtcatatcggctgtttgtggaccaagaatggaggagatatcaactttagcgttaccggttaatgtcactttaccgggttcggcccggccaatttggctctgtaactgtgtcagggtgatattggcatcaaccagacccggaataccgatctgtttttcataattattatgtttttgcaggtattcgttaagttcctgctcgctgagtgtgtactgagtcagttggttacagccaaccagtgtggcagtaaccacaagggcagcagcgccccacattaattttttcatcaaagcctcatcgcaatatgcacaattcataattcataattcataattcactacaatatgatggtctatccaacacaatagggtctatccaacataatacgcacgattcaatagagggctattcaacacaatatggatctacttaagccaccctatgcagggactgcccgcaaactggcccaatagtaaccggttaaccggtggttttgcattattaaccgtgttcgttcagcaaccgtttggggcgggtacgttgacgtaagtactggtttaggtgtcggagcgcaatagtgtcggagtgcatatagtgtagcagtgtatgccatctgccaatcagataaccctgaagaccgcgccgtatgcgcgaggaatgtgcttatcaaccggaaaggcaaaacgtctccggttgataagggacataacgttagctgctgctcaacatggcagattcaatccgccgtcgattgaattgccagtaaagccctgccaatgtaatgagtccaataatacccagcaagaaccagggtagctcaggcatatcaagggttttgccggtatcgtacatccagccaccgccggtataacctaatgccccccccagcgctaatccaaggcgactaaagcccatatagctaccacgggcgcgggagtcagccagcgatgctcccagcgtttcacgggcgggttcagcgaggattgatcccatatagaagaaacagataaacatgaacagtgtttgtagatgagtgatcatcccgatggggaacaaactgagcgtcatgatcagtaagccggccattaagcgttgctcaaggctaaaacgcttttcactccaacgggccagcggataaagcagcgtcagagaaagtgcggcttcaatggcatacatccattttactgcggccggtgagcccgcaagttcattcaccacgatcggcagcatcagcatgacctgtacggcgagcatataatagccagtaagcgtcagcacataggtcacaaaacggcgatcacgcaacactcgcatcaggccctctttcatcggggcgcgaacggtcgagatacggtaagcggggagtaaccaggcgttccaaccggctgccagcacaaaaatagccgcaccggtccaacagacgaagtggaagtcatattgcagcagccaactgccaatcaacgcaccaattaccgctccggcgctatcctgcatcattagcagcgaataaaaacggcctcgttcatgggggcgggtcaacttgatgaccaacgctgtgcgtggtggatcaaacagggtgccgcccagccctgacagcgcacaggccagccaaagtatccaaggttcatccgccatggccatcaaggcaaaacccgcggctcgcattagcatcccggtgacaatcatcggtttggcaccgaaccggtcggcaatggctccgccaaagatccccaatccttgttgaaccaattgccttaggcctaaagcaaggcccacgaccaacgcagcccaacctaattgatcgacaaatcggatagaaatgagcgggaatacgacaaaaaatcccaacacaactaataaattatcaaacaataaaaaatacttacccaagcttcgagcttgcgataccaaagccatgcttcaccgtcagaacttaaaaataggagggaataaaataaataggcttatagtttgtacccaaattgatataaacgataggggttaccgggataatatttttatcgtcaatacattacctcaacgagagtttcataataaaatgcttattcagcagtttggttgcgtaataatgcggcttggtgtcacgaaaaggcggccaaggtgcttttacgcgatgtccctataacaggtatattgaaccatatagattgtgattcaattgagtacactgtctagtctaaggggagcagatgttcggttatcatacagcaacacccaaagtacacctgacgactgaccgtatgtcattgaggctggtccatgaacgtgatgcttatcgcttggcggagtattacgctgaaaatcaggtgtttcttaaaccgtgggaacccgtacgagatcaaagtcattgtatgccgtcggggtggcaggcgagactgggaatgatcatggaactgcaaaagcagggcagcgcttattactttattctgttagatccggaagaaaaagaagtacgtggtgtggctaattttagcaatgtgttacgcggatcatttcatgcttgtttcctcggctactctctaggggagcgctggcaaggccaagggttaatgtttgaagcattgcagccactgattcgttatatgcagcggcaagagcggatgcaccgtatcatggcgaattacatgccgcataatcatcgcagtggcaatttgttagcgcggcttggttttgagcgcgaaggctatgcgaaagattatttaatgattgatgggcagtggcgcgatcatgtgctgacggccttaactaacaaagagtgggcgtctactcgctgaggttagaatgaaacacaacttaaatgcacatgaagcccgtgttatcggctgtttattggaaaaacaagtgacaacaccggaacaatatccgatgtcactcaatggactcactctcgcttgtaatcaaaaaaccagccgtgatcctgtaatggaattatccgaatcacaagtacaacaaacgttagattttctccttaaaaaacaccttatccgcagccaaagtggtaatcgggtaatgaagtacgaacatcgtttttgcaattctgaatttggcgacctgaaattttcacccgccgaggtcgcggtgattaccctgctattattacgtggcgcacaaacaccgggggagctacgcacccgaactaaccggatgtatgaatttgctgatgttgcagaaaccgaagaaaccttgaagacgctctctctacgtgaagacgggccatttgtggtgcgtttggcacgggaaccgggtaaacgcgaaagtcgctttatgcctctgtttagtggggacgttgcttcgtcattattggcagcgggagaggctgaagagaataaccacacccttgaagccaacccccgtgaaacgcattcctttgaaaatatagcccttgaaaaaacagcccttgaagctagggttgcccagcttgaacagcaggttatccagttgtcacgccgtttggacgacgtgttgattcaactggatgattgataaggacgatatgaaaaaactacgcgtgggtatcgtggggctggggggcattgcgcaaaaggcttatttgcctattttaactcaggcgcagggttggcaactggttggcgcattttcacccaatcaagctaaagctcaaccgctatgtgatagctatcgtatgcgttatttttcacgcttggatacgctcgctgcggcaagtgatgccgtttttgtccatagtagtaccgccagccattttcaggtcgtgcatgatttattgcaggccggagtccatgtctatgtggataaacccctggctgaaacacgagagcaatcagagcaattgatcgaactggcagataaacagcatttagcgctgatggtgggttttaatcgccgttttgccccgttatatcagcagttgaaacaacaggcgagcagcccggtctcactgcggatggagaagcaccggctaagtagcatcgggccacacgacttaggttttaccttgctcgatgactatctgcatgtcgtggatacggcgctgtggctaggcggtgagggggcaagattgacgggtggggcagttcagaccaatgctcaggggcagatgctgtatgcggagcaccatttccagcaaggtggttgtttgatcaccaccagtatgcaccgtcaggccggaactcagcgggaaagcgtgcaagttgtcagtgacggtgcctgttatcacattaccgatatgcgccaatggcagcaggcgtcagcggggcaggtgataagccaacctgctcccggctggcaaacgacattggaacaacgtggttttaccggggctgtgcatcatttcattgaggcggtcagtaatcaaacgaggccgcaagtctcaggtgaagatgcgattgttgcacaacgtatgattgagcgtattttgcagcagtagatgatgtttacagtaatagacgatgagatcatcggttggcatgacatcacatcaagatcacgtggtgagagtgaaaatcgattggcttcagtaattggttacaccttgcagtggctattcatgattcgatacgtagactgttgccagttttgctatcgtctttagggccgtgttgataacggcgaatcccccattgggtagagcaacgcctgcagaccgtaggcgttggtatttacagcacattagaaaacagatcaaaagaacctatgaatctattgaaatcactggccgccgtcagttccatgacgatgttttcccgcgtgctgggctttgcccgcgatgccatcgtggcacgggtatttggtgcaggtatggcgacggacgccttttttgtggcatttaaattgcctaacttgctgcggcgaatatttgctgaaggcgcattttcccaagcttttgtgcctattctggctgaatacaaaagccagcaaggggaagaggcgacgcgaacattagtggcttatgtctctggcctgttaaccttgatattggcggtcgtcaccgtcgcggggatgctggccgcgccttgggtgatcttcatttccgcccccggctttactgatacaccggataaatttgctctgacctcggcgctgttacgggtgactttcccgtatattttgctgatctcattggcctcgctagtcggagcgatccttaatacctggaaccgtttttctattccggcttttgcgccaaccctcctcaatgtcagcatgataggttttgcgctgtttgctgcgcctcatttcaacccgccggtgatggcattggcttgggctgtggtggtggggggagtgttacaattaggctatcaactcccgcacctaaaaaaaatcggcatgttggtattacctcggctgtcgctacgtgataccggtgtttggcgggtgatgcgccagatggggccagcgatcctcggggtatcagtcagtcagatttccctgattatcaatacgatttttgcatcatttttggtatctggttcggtctcctggatgtactacgctgaccgtctgatggagttcccctccggggtgttagggggcgcgttaggtactatcctgctgccatcactggcaaagagtttttccagtgctaatcatgatgaatattccagattgatggattgggggctgcgtctttgcttcttactggccttgccaagcgcggtggcattaggaattttagctaaaccgctaatcgtctcgttattccaatacgggaaatttagcgcgtttgacaccctgatgacacaacgggcgctggtggcctattcggtgggcttgatggggttgatcgtggtgaaggttctggctccggggttttattctcgtcagaatattaaaacgccggtaaaaatcgcgattattaccttgatactcacgcaagtcatgaacttgatcttcattgggccgtttaaacacgcgggcttatcactgtctatcggcctgggggcatgtctgaatgccagtttgctctattggcagctacgtaaacagaaaattttccagccacagccggggtgggccatattcctgactaaattggtcatcggtgttatcgcgatgtctgcggtgctgctagggttactgtgggtcatgcctgattgggatgttggcgggatggcgtatcggttgctacggttatctgcggttgttgttgccggtgctagcgcctactttgccatgttggcattattaggctttaaagtgcgtgattttgcccgtagaacgggctgaccttactaatcaactaatcaactaatcaactaatcaatcagtattggtaatctaaataaacaatgtattatatagcccgataatttcgggcttttttacatatttacaatacatatttacaacacatgctcacaatctaagtccataatccacaacaaaaacctgcaaaccacaatctatatctgcaacaaaaaaaacatcaataatatataaaccattattcgtttttaattgaatatatttgaattgactttattgcgttatcaatcattaaattcaatttaataatcttaccatgaatttttttgtttttttttaacgtgtatttttaatgcatgttttttaaaaaactaaactttggtttaacccgcacatctagtgtgttgttaatcatctgtttttttgattctctcgtatattgaatttattcatgggtattataataaatgaatatcgcgctcagaaaagaatgtgtaattattttgttgctcagtaatactgtttgggcaacggaaagcgatcaaattatattgaataaaaatatggcatcgcacaccgagattaatacgatccataaatataaagaggaacacaccaacgtcgggaaacatttcttatctacaaaccgtcatgagactgcatcacaggaaaaaatatccccagagaaaatatgcctgccaattactggggtatttttacaagggaatacacgactgtcatcgcaagacttaaatcagattgatcatattcttggtgaatgcattagtgaaaatgatattaattccttagctaaggaagtgactcgattatatttgtctaaaggttatctggcggccagagtcaatttcattccattaaataatgcgggggagttgggactgaatgtgactgagggtattgttgaaaaaattgaaggtggaggacgaagagtcaacccttattttatattccctaactttattgataaaccccttcggttatccgagcttgatcaggccatcgatcaggctaacagactacgatcaaataaagtaaacgtcgatatcttaccaggaagtcaggcgggcaaatcaattattagaattaataatgtcaataataaaccttggagcttatcgaccgtcattgataattatggttataaaaattctgatgagtggcaagcaagagtgtcactggctttagatagcccatttgggctatctgacgctattaattttaatgctaaccgcacgctagagaatgcgaagagtcgctacaagaatgattttactgtttcttattcggtaccttatggtgcattaactgtcagcgcccttgctaaccatctggaataccggcgctatgagaaattaaaaaatgggacagtgaattttaatggtaactcacagcagtataacttccgtactgactatatgttccatcgtgcacaaaagcagataaacagtttaagtatgcaagtagagcacaaacagattaataactatgtcgatgaggcaaaagtaggtgtctacagttatcgatttactaatcttgaattaggtgtcaatcaatttcgtattcttcctcatggttcagtgaatgttaatgcggcaataaaaagaggtgtgccatggtttggtactcatcagaaaaataaaataaatgcagtacaatttaccacaggaaaattgatggttaattttaatcacaatttctctctattaaattcgtcgtaccaatttgatcatgctttagttgggcaatacagtaagaattatgcgccttctcctgagtggataaatttgactgaacgtaatgccattagaggatttagtcgtagttcgcaatcggcagataacggttggtatataaaaaatacgttatcccgccacttctttatgggaaatgtgctttttacccctcgtattggcattgatgctgggcgtgctttaagacaagacagccaacaagggtggcaaagtaataccggtgtaagtgccgggatatcaatgcgttaccataatgcattttttgatgtggaagccagtcgtggttggtggctttccgatagtaataaacagaacgaacctgtacaggtattgggccgtatagcttataccttctaactcaacgtaatttaaataaggttattttaatgaaaataaataaatttaaactttccccagcaggaaagttgacggttatcttatctttaattcttactccaatcacaaatagctattctgctgaaatagaagcggcgggaaatacgtacatgaggggtagtgaacatattccaagtgtttataataatcctgatggtgtgagtgtgataaatatcgctcctccgtcagagcatggtctctcgcataatcaatatatggaatttcatgttaatgaacatggggtcgtgtttaataactcacttgagcgagttgtaaagaatggattgacttatgatgctaaccttaatttacgtggctcacaagcacgtgtgatattaaatgaagtggtggggccaaatgcttcagtattggctgggcaccaggatatcgtaggcatacctgcagattatattctggcaaatgttaacggtattagctgtcagggatgtagttttgcgccagagtttaaaaatgtcacgttagctgtagggaaagtcgttacggtccgtggtgatctacgcagtatagataccatagggaatgctaatttattgaatgtgtcaaatgatcgcgatgataataatatggctgatgcattgacactcattgcgccagttattagcactaatggccacattaaagtcaaagacgatgcggattttgttgtgggccaaaatatgtaccattttatgaaagataaaactccagaggtagaagcaggtaatagtaaaataaaaacaattgatggctactatcttggcagtatttccgctaaccgtattaatttagttgacacaagggaagataataacattaatttatttggtgatgtgaccgcagaggaaaccaaggtggtcacctctggcacgttgcgattaagagcggcagaagacggcaggcaggatataaccataaaaaatggaatgaatatatcggcgaacaagattgatactacacgggaatttacttctgatgaagtgaagttatttgacataaaagaaaataaaatcaaccaaaccattatttctgctggccgtgttgattttattgctgtcgaagatgttaaattgtcaggtactacaattttaagtaatgatgatctctcaattacggcaaagagtttacatgttgactcacatttaattaagcattcacaggatacaggagtggtagttactcatgtgaatattcttgatgcgccaactaagaaagtagaaattaaaaacaatgatcatgtttcgcaagccagtgcaattattagtcggaagaatgttaaattacatgggcaggatggtttagaactgaaaaatgccaatgtacaagcctatggtaatattaaattgtcttctgaaggtgatattcatttaaatggttcaactgaaactaatactacaataaataacattacctatattaattatgatgaggacttgaaaagaggtcataataatgtagaaaccgtcactgaaaggttcgcccctcttgatatgaaggcgagggggaatattgatatacagagcaaaaacacgcatatccatggtgccaaaatagcttcagagggtgagttatcaatagatgccaagggtgacgtctatattgggctggcaagtatgttaacttcagagtttaaagatattgactacaatatgtgggggggggctcatggttcggaaaaagacaagatagaagagtatgtttataccggcaataagtcagatttagttggagggcgggtaaaaatcactgcgggtaatgacgccagaatactcggtggaaaaataaatggattaaatggcggagagatctcggctcaaaattatctgagtattgatggtgtgttggggacacgcagctttaaaagggatcaaaaaactggtggtataatgcataccaacgagagtgcttctacttccaaaaatcactatgaaaaatttatcgacagcgaaattagttctgatggtgatttccgcatattcagtcaaaaagatctttatattgatggtagtcgaattaatgtaaacggaaagctagatattaatgctaatgataagttgaccgtacaggctgctcgtcagcaacaaaaaatagatgaggaaaaaacccgcctcagcatagagtggtttgctaaagaaagcagtgataaacagtatcgtacgggcattctcattaatcatcaaaaagacactgaaaatacactgagagatgaacacaaaattgcaacattaagtgcagaacagattaatatcactgccggagacgatattaaattctttggcactggcatcagtacttctaagggtgacgtgataataaacacacccaaaaatattgggtttttcaccgcaaaaaaccgtgcactaatcaataaaaatcaggttaataatagtgggggtttttatttcacgtcagggatggataaaacaggtaatggcttacaatatacccatattgataaagaaagttacagtgacattgagaataatctggtcgttaaaacgcatattaagggtgatttaaatattaatgcaggaggcgatcttaatcagcaagggacacagcatgatgtggctaaaaactatttagttgaagcctcgaatatcaataatatggcgagcaataatcttgctttctccaaaacagatacattacaggttgatgtcagcatcggtaataatattgatcacagcggaatgacccgtccaatagaaaaagtcattaaagatccggctaatacgcttgattatatcggtggtaggggaagccaaaaaggtatttcagacccaacgattggtctggatgttgatgtagtaggcagtcgtaccaaaacgtcagacaatgacgcgttagcgttggttacctcgattaaagcccaagacattaagcaggtggcgaaaaaagatgtgctggatgaagggacccaatatcacgctaccgagggcggtatgagtttacagggggcacgtcatttcagccgtgccgcagtaaacagtaaagccagtacaatcgagaaagaaaaaggtgaggtaagtcttcgggggggcatgacggccactcaggagataaaaggccatctgggggttaaggtagagaccagccagggggacagctatgctgaagagatgttggccgggaatattaatgccaagtcgggggtttctatcaaaacgaccggggatgcctattattatgcgactaatattgagggggaaaatggggatatcaccattgatgcgggcaataatctttattttgaccaggtacaggatagccaacgcagcagtaatataaaattttcgggtaatggaaaactgagtctcggtggctcttctggcagcaaggagtttcgccttgaagggggcgggggctaccaacaaggtcgaagccagcgcactgacgctattgtaagtaaaatcaatacacagggtaatgtaacgctcaaagcgggcgcggatcttactacaaaaggtatgcagatcggcaagcaaggaacccgggcaagcgatgtctctttgttggcggctggagaggtcaaactgttggccgcggtgtctggcagtgccgatattaatgatggtgcgctggccgacttccgtctgggggggaaacgagcaacaggcggtgcttcaaaagaaggttttgtgggagcaggcgttcaggctgataaagtcaatcaatcggtttctgaccgtcagggcggccatatttatagtaagaatacggtgtctataaaatcagacagtgacagcaatcaagccatccatttagaagggttaaaaattgatgcaccaaaagtcgatttgagtgcgcaacagggtggggtatttatcgagtctgcattaagtgaattgccaaaggataattggaattttgggtttaacctggatatggtcctgaaaaacacatcgcctaaaaaagaagatggaacaattgacaaggataaagccagtgaaagtcattataaaggtgctggcattaaagtaatggtggataaacaagatatgtttaaacatcagaatgcgcatatcaacactgcatatttttctttgaataccaaaaaagatgcagtaatgaaaggggcgcgaattgagagcacgcgggctgatgttaacgtgggccgggacctgacgatcgaaagcctcaagagtaaggaagacagtgtcaaggtggatgtggagttatccctaagccataccaatgataaaggcagcagtgttacagctaaactctcgaagttcggtactaagaaattcgagaaagaggttcaaggaacgttagactcaggtattaaaaaaaccgggttaatgtataacaacaaagtaaaaccaaaagatacgatgggcggggttggtttcagtaaagaatcggacagcgtataccttccaccattatctgctgagacaaaatcccgtaattttggtgataaaacggtacgctatctgggcggtgaattgaaggggatcgccagcggcccagaaggttttggggggcgtgctaagttggatgtgcaagtcgtaaacaatgatgctgttgctgaacaatccggtatttttggtctctatgagatgaatgttacggtaaaaggaaccaccaaattgcacggcgcggaaataagcagtgaattaggactgctcaccttgaaaacagagaacagggaactgagcaatattaaaaatagtactcacaaggggggcggtggctttaatgtttctcctagtgtattagggaatttaaccggggctggtaaagatgcctcggaggggaaaacgccctttattcatcaccctcacaatagttcagatgagagtgagtctgttggtaaaatcaagggtgaaaaaaatactggcggtgcttttgatgaactcccttctagcctaacaaatcactaataaagatgaaatgtaagtacacaagctaatcgttttttaaggccccgaggggccttttttgacgatttacatccgctcaacggtttgaatacccaaggtatccaggccttgtttcagcgtcttagcggttaacattgccaatttcaagcggctttggcggatctcttcgctctctgcattcaggatctggcaatgctcgtagaagctggagaacaagcctgctaaatcatagagataagaacacatgacatgcggtgtaccttcgcgtgccaccgtggtgatgatctcttcaaactgcaacaggcgggtcgccaaggcggcttcgcgatcttctgtaatcactaatggcagcgtcaggctggtttcatcaacacccgcacgtctaaatactgaaaccacgcgagtataagcatattgcatataaggcgcggtattgccatccaacgccagcatattatcccaatcgaaaatatagtctgtggttcggctcttggacaaatcggcatatttcaccgcgccaatccccaccgcattgatcacttgcttcaattcatcggcaggcatatccgggtttttctcggcaatcaacttgccagcacgttcaaccgcctcgtccagtaaatcggataatttgacggtaccaccagagcgggttttaaacggtttgccatctttgcccagcatcatgccgaacatgtggtgttccagtggcacggattctggcacataaccggctttacgcacgatggtccaggcttgcatcaaatgctgatgctggcggctatcgatgtaatagagtatccggtctgcgcccagcgtttcgtaacggtatttggcgcaggcaatatcggtagtggtgtaaaggtagccgccatcctttttctggatgatgacgcccattggctcaccgtctttattcttatattcatccagatagacaacggtcgcgccttcgctctcgacggccaaccctttggctttcaaatccgcgacaatctctggtagcatcgcgttgtacaggctttcacccattacgtcgtctttggtcaaggtgacattcaggcggtcataggcaacctggttttgcgccatggtgatatccaccaatttacgccacatttgacggcagtattcgtccccactttgcagttttacgacataggcacgggcacgcagagcaaactcttcgtcttcgtcgtaggttttcttcgcttgttgatagaaaagctccagatccgatagccccatatcactggcattttcgttctgcattttctccaggtaggcgatcaacatgccaaactgagtaccccagtcaccgacgtggttggcacggataacgttatggcccaaaaacgccaatgtccgtactgcagcatcaccaataatggtggagcgcaggtgaccaacgtgcatctgtttagccacgttaggtgctgaataatcgactacgatagtttgcggttcgacaggcgcgacgcccaatttaggcgcagtcagagcatattcgactttctcggccacccactgacgatccagaaaaatattgataaaaccggggcctgcaatttcaatcttactggcgatacctgtaaggtcgagcagttcaacgactctttctgccagttgtcggggttgcatgccaagttttttggcaacggccatcacaccgttagcttgataatcgccaaattgagctttggcagattggcgaacttgagcttcgcaatctgcgggagcacctgctgcaatcagcgcctggctgactttatctgagagaagagcctgaatattcaccgggttaccttaattacatacgaaagacagattaattatgcacaaaaaattctggatcagtcacatttctgtgccagtgactcatttctgtgtcagttacatattcttgtatcaactacatgcttttgtatcaactacatatattgtgctgtgtcagctaaacaggaacgcagtctggtggcctcactcgtcgagtgttgacagcaaggtagccagacggagtgtgagtcataagctggcaggatttatatcatatttggctatcggcgtcagtaccaggcccgtggttgcggcgaatctcatcgccaaagaggctaagtggcaattttattcgcctccccttcgaacttgaagccataagagctaacggtgttcactcactcgaatcatatctttaatgtcaattcggtgagatttgtttgttggcctggcggcaacgccagtgacgttgggtataaaaagaggggtagattatatctggctgacgagcataaataacggtaaattgttgccgcttcaacaccctacctaacccatcagacggagaaccacatgcacggcctggaagagatcattgaattacaggacttgttagcagacctaccgcgctttgagcaacagttagtcgcttttgctacccaattgaatttggatttaacgcaattttgcgctgatcatatctcattacgttgtcatcaagctgaaaccgcagagcgctggcgtctcgggttacaacaatgtggccatttgatgtctgagacattgattaacggacggccaatttgcctgtttgatatgacacaaccgctgaatgttgggccatggttgatagattgtattgagttaccgtatcccggtaaaaaacattacccacacgaggggtgggaacatattgaacttgttttaccgggtgacccacagacgttaatgcaccgcgcccgaacactattaccggcggtgttgccagcaggggtgagcgtgaaatgcagttcgccacacggggaacacgagcgtctatctaacccgacactggcagtgagtgatggggagataacgattaagtttcatccatatactttgcgccaaattattttacgccaaattgttgatagcgggcacggtcgctaacgtatatgggttatttatttcaataacgactatcacttatggttatcactgtgactgacatctactcatcaatttaaaatgagtgccatagtcaatagttcagcatggttaatcgtattctgttttggttcgagagagatattcggcattttgttaatttgccagtgaatcattaattttcaggtgatttacactcactgtcgcagtgaaatctgtcaaacgggggagataatgactaaattggaagtttgttgctatagcgttgattgtgcacaaatagcagaaaaggcaggagccgaccgggttgaattgtgctgtggtcagtctgaaggggggttgacgccgagtgtcggcgcattaatgcaggccagagaaaccgtgactatcccggttcatccgatagttcggccacgtggtggtgatttttgttacagcagcaatgattttactattatgaaaaatgatattgcgcggatccgtgacttgggctttgctggcgtcgtcgttggcgtactggatacggatgggcatatcgatatgccacggatgcgggagattatgtcagtaagtggttcactggcggtaaccttccatcgcgcatttgatatgtgccaaaatccgatgattgccttaaagcaattggctgaacttaatgtggcgcgtattttaacctcagggcagcagcaaaatgctgaattgggtttagctctgttgaaagatttggttgcagcaaccaaggatcaaggcccgattattatggcaggggccggggtgcggttgacgaatatgcagaagtttattgatgcagggattcgtgaattacacagttctgccgggcggacggtgccatcaaccatgcgataccgtaaagccggggtgacgatgtgcgccgacagtgatgtcgatgagttttctcactattgtgttgatggtgaggtcgttgaagctatgaagagtttattggttatgggatcgcctcttgccaagcacacctagtgcgcctaattcagtacacgatatattgatatctatccctcttacgtgaagttgcagggtggttagctgctctcaattatctgagttacgggggtgtcaattcggggatgcgcgcgttttgccctgtagtaacaccacttgtttggaatataacgaacggtatcccccatctgggtgagttgggggattttcttatggcttacgggcgattaacaccgctcttagtggtgctggatagccttctaccgttttactgtgatcgtgcgggtcaaggaactcggctaatgattcactggtcatccaatcagtacgacgctgctcttcagtcgtagtcacggccatatccgctattctgacatcaacgaaaccacacttctccagccaggcttttagggcgggtgccgaaggaataaagtacacattgcgcatttgcgcgtaacgatcacctggcaccaacacttgttggctgtccccttcgacgaccagtgtctctagcaccagttctccgtcagtaactaactggtttttaagttgatagaggtgatccagtggcgaacggcggtgatacagcacccccatggaaaacacggtatcaaaagcagccagttccggcagttgttcaatgccaagaggcaggacatgcgctcgctgatcgccacccaaaagcttacggatcgcttcaaactgacataaaaatagctgcattggatcaatgccgaccgccagatgggcaccttcaccaatcatgcgccacaggtggtaaccgctgccgcagccgacatccagaatagtacggcctgccaatgggctgatatggggcaagacccgttgccacttccaatctgaacgccattcggtatcgatctccaacccatatagcgagaaggggcctttgcgccaaggcatcagggcgcgcagcatattctccattccttcacgttgcccagccgaaatgggcggggacatttcggcccttacgcctgagtgtagatccagtgtggtgggcgtcagttgaggcaaatgttccacggcgttaaaccaggttttaaatttaccgtgtaacgattcgcgctgccaggcgctgagctgtgcgggcagaatatctaaccatgggcttaatgggcctttggcaatcagccgataaaaatcgccaaattcaatcattgagcctctcctgctttcagggcaatcagtgaaccaaaattaaagcattggaaccagacttccgcgtgttcaaaccccgcctgatgcagacgatttttgtgggtttccacggaatcggtcagcatgacattttccaacatgctgcgtttttggctgatttccagctcactgtaaccattggcgcgtttaaaatcgtggtgcatattgaacaataattcgcctacgttatgatcggcaaaactgaatttttctgacaatacgagtgcgccacctgggcgcagcccttgatatacctgattgagtaggcgctggcgattggcaggttcgagaaattgcaaggtgaagttcaacaccaccatcgatgcgttttccagtttgatatccaaaatatcggcttcaaccacgtctaccggcgtctctgcccggaaagcatcaatatggcgacggcaacgttcaaccatcgcgggtgagttatccactgcgataattttgcagccttcggccttaatattacggcgcattgacagcgtggcggcacccagcgaacaaccaaggtcataaatttggctgttcggttgcacaaaacgctctgccagcatgccgatcatcgaaataatatttgaatagccgggaaccgagcgctggatcatatcggggaacacttcagcgactttctcgtcaaaggtccagtcacctaatttagcaataggcgcagcaaacaggctatcgcgctggggttctgccgcctctggagaatgacgtggcgtatcgttttgagattgagtatcgcggtttggcatggcgtctgagattctgagataaacaaagcaagaaattaaaggcgcatattataacagaaaacttggccgataagcgtgataaagcgaggggcgcgagaggggaataaacataaaggcggcgatatgccgcccagactaacggttgctccggttatcttactgtcggaacagggactgccttaatgcagaatcaggtaaaactgaaaatctgatcccacggtaaatagtaaatattcgcaataatcattaatacgagtgaaacataggtggcactcatcccggagcgacgccagcgaatttcgcgatgacgtaacccataataatgtagcaggcggccgacgattagcattaatccacaaatatggatcatccacgtcagcgcgccgttcatttccatcataatgagtaaaatgacagcgatgggtatgtattctacggcgttgccgtgtacacggatggcggtctgcaattcataaaaaccaccgtcaccataagctacccggtactggtttctcaatttaaccacatcgaatgacagcttgattaataacagtgcgcccaacaccacataaagagagctaaccattttcaactccattgcccaaccatagactggctgaataatgataaccgtctactgggtggctgtcgctagaaaaatggcgaacttatcatttattgactcttaatttgcagcgcgaaaagataaggctgagagcacgattatgcgcactcctcactgatgtgactaacacgctgaagtgactaaaagagtgtctcttgctctggccaatcgggtgcggtgggcaatgtcgggatggcttctgccaacttttgccaaattttttgagcttgctgtggtgaatcgctgttatcgggcgtgtgaataaaaacgtagggttgatggtgctgttcccataaaggcagtttttgtagccagggtgcaaacagggccaagttgtcatccaattggtcgccaccaataaagcgcactaaaggttggccgccagtgacgacagcatgtactggcaaacggggtttcttactttgagcatcacgaacggcggcggttaaaggcttggcggcgtgaatagggcggctatcgagcatcacccgattaattgaacgctgatgtaacccttgattaagggctaattctgcggcacctttggcaaaaaactctgggtgtcggacttccacgccataatgaaaaccagcgggtaacttatcgataaactgccacaaacggtccaattcatttggcccaaaggcggcaggcagttgtaaccacagttgaccaatgcgatcattcagcggagccaggcaatgataaaaagcctgtagttctttatcacagtcacgcagagccgcctgatggctgattgtggcggggaatttaaagcagaaacggaaactgtccggtgtcatatcacgccagcgcagcacaatttctggccgtggcaatgcataaaaggtggtattaccctcaacgcaattaaaatagcggctatagtccgccaagtctcgaagacccagtcggccccaggccgggtgttgccattgcggcagtccgatatacatcttttacccttcttacttgacgctacagcgttgttagctgctctctctcacccgaatcacttactgatgtaagctcatcgggacgcgttcgtttgctgcctagctgtaacgccaattaatttgggtcattcccttcttacttgacgttacggtgttgttagctgctctctctcacccgaatcacttactgatgtaagctcatcgggacgcgttcgtttgctgcctagctgtaacgccaattaatttgggtcattcccttcttacttgacgttacggtgttgttagctggtctctctcacccgaatcacttactgatgtaagcgcatcgggacgcgttcgtttgctgccccggcagatttgtcgcccgaaataggtaatctgctgaccaaataatgtcaacataggttatcagctagcctatgtcagggggtgattttgttaaatgatgcgttaaaatctcactgaaaggaattttgtcgtgcctgagctgtgtgttcgctcttatctatgccatgaatttcctttataatgacccccttttttcaacgctctttaacccaaaacacctctgcctatatacggtttcttttggataaaatagggcgtgtagcgcttgcaaccatcgattagcctgtatttttgaaaaaatctctgtgccagcttccaacgaaaaggcacgcgacagatttaaaaccgggcgttaagcagagagcagtcactgaggttgaaacaatgctgaggttgaaacaataacgcgttaatacaacataacgcgttaataaaacaataaagtgttaataaatagaacacagcggtttaccaaagcgtaaagttgaccaaaacgtaagatttaccaaaacattaggtttaccaaaacattaggtttaccaaaacattaggtttaccagaatacagggttcaccagaaaatcgccgcacggagagtgcataacgcgtgcggcatcggctgagtaaaaggatattgtatgcgtactgaatattgcgggcagttgaatctgtcccacgtgggccaaagcgttacactttgtggttgggttaaccgtcgtcgtgatctgggtggcctgatttttattgatatgcgcgatcgcgaaggcatcgttcaggtattcttcgatccagaccataaagccgcttttgaacaagcttctgagttgcgtaatgagttctgtattcagattaccggtactgtgcgtgcacgtcctgacagtcaaatcaataaagatatgtccaccggtgaagtggaaatctttgctaacacgctgaatatcattaatcgctccgagccattgccgttagattccaatcaaatcaacagtgaagagcagcggttgaaatatcgctatctggatctgcgccgcccggaaatggctgatcgcttgaagtcccgtgccaaaatcaccagttttgtacgccgcttcatggacgatcatggcttcctggatatcgaaaccccgatgttgaccaaagcgacaccggaaggcgcccgtgactatctggtgccaagccgtgtgcataaaggcaagttttacgctttgccacagtctcctcagcttttcaaacagttgctgatgatgtctggctttgaccgttactatcagatcgtaaaatgcttccgtgacgaagatttacgtgctgaccgccagcctgaatttacccagatcgatgttgaaacttcgttcatgagcgcagatcaagtgcgtgaagtgatggaaaaattggtccgtgaattgtggcaggaaaccaaaggcgttgatctgggtgatttcccggtaatgacctttgctgaagcgatgcgtcgttatggttccgataagccagacctgcgtaacccactggaattagtggatgtcgcctctctggttaaagatgttgaatttaaagtgttctccggtccggccaatgatgccaaagggcgagtggctgcgctacgtgtaccgggtggcgcgcaacttagccgcaaacaaattgatgagtatggtcagtttgtcggtatttatggtgcgaaaggcttggcatggctgaaggtcaatgaccgtgctgcaggtcttgaaggggtacaaagcccgatagccaaattcctcagtgctgaagtgttggacgccattttggtggccactcaggcggaaagtggcgatatcctgttcttcggcgcggacagttacaagattgtgaccgatgcgatgggggcgttgcgtctgaaagtagggcgtgatctcgagttgacgcgtctggggacatgggcaccgttatgggtggttgatttcccaatgtttgaagatgatagcgaaggcggcctgacggccatgcatcatccattcaccgccccaaaagatatgagcccggaacaactggccgcagcaccaaccaccgctatcgccaatgcttacgacatggtgatcaacggctatgaagtgggcgggggttctgtgcgtattcatcgcactgaaatgcagcaaacggtctttggtattctgggcatcactgaggatgaacagcgtgagaagtttggcttcttgctggatgcgctgaaatttggcaccccgccacatgcgggcctggcgtttggtctggatcgtctggtcatgttgttgaccggtaccgataacatccgtgacgtcattgccttccctaaaacgactgcggcggcttgtctgatgaccgatgcgccaagttttgccaacccggcctcgttgcaagagttgtccattagcgtggtggcgaagaaaggcactacagatgctggggcagaagagaatcagtaatgaattataaacgccccgagtcggttctggtcgtcatctatgccaaatccagcgggcgagtgttgatgttgcaacggcgcgatgatcctgatttttggcagtcggtgaccggcagtctggaagagggggaggctccgttgcaaaccgcacagcgcgaagtaaaggaagaagtcggcattgacattctgggtgaaaatctggtgttgctcgactgtcagcgctgtgtggagtttgaactctttgcgcatttgcgccgtcgctatgctccgggaattacgcgtaacaaagaacattggttctgtttggcgttgccggaggagcgggatatcgtgattactgagcatctcgcctaccagtggttggatgcggcagaggctgccgtattgaccaagtcctggagtaatcaacaagcgattgaagagtatgttctttattccgtctagacccaacgctgtcacgtcaggtgtgaagggtatcattaggctattttggagattcttatggcaggtcatagtaaatgggccaacacaaaacaccgcaaagcggcacaggatgccaaacgcggtaagattttcactaaaatcattcgtgaactcgtcactgcagcccgtctgggcggtggtgaccccggtgctaacccacgtctccgtgcggctatcgacaaagcgttgtcaaacaatatgacacgcgacaccctaaaccgggcgattgcccgtggcgtgggtggtgatgaagataacaacatggaaaccatcatttacgaaggttatggcccaggtggcacagccgtaatggttgaatgcttgagtgacaatcgtaaccgtaccgtatctgaagttcgccatgcattcaccaaaacaggggggaatctgggcactgatggttctgtttcttatctgtttaccaaaaaaggcgttatttcttatgcgccgggtttggaagaagatacggtgatggatgcagcgttagaagcgggtgcagatgatatcgtggtttacgatgatggtgcgatcgatgtgtttactgcatgggaatctctgggcgcggtaaaagatgcgttggatgctaccggtttggtggctgaaggtgcagaagtgtcattaatcccatcaaccaaagcggaattggatgctgaaactgcccccaaactgctgcgtttgattgatatgctggaagattctgatgatgtgcaagaggtttaccataacggtgaaatctctgatgaagtagcagcaaccctgtaagcgttatcgcatcgcaatttgcagaatgcaggcaccacacttatttatactctaaataattcgagttgcagtggcctccatggatggagtgagtaacgaacgtagccaacgcacaggcaacttgaagtaggacggggatatcgggtgaggtgctttccccatcaatacggctgctcaatcaggtggcgaataaggtaaataaacgagtatggcgatcgtattaggtatcgaccccggttctcgtgttaccggctatggtgttatccgccagcaaggtcgtcaacttacgtatctgggcagtggctgtatccgcactgtggttgacgatatgcctactcgcttgaagttgatatacgcaggtgtgaccgaaatcattacgcagtttcagccagatttttttgctatcgaacaagtctttatggcaaaaaatccggactcggcattaaaactggggcaagcgcgtggcgcggccattgtggcggcagtaaacctcaatttacctgtctctgaatacgccgcacgtcaggtaaaacagacggttgtagggaccggcgcggcagaaaaaagccaggtccagcacatggtgcgctccctgcttaaattaccggcgaatccacaagcggatgcggcggatgcattagctatcgccattacacattgtcatctgagccaaaatacgttgcgtttgggtaatgaccaaatgacattatcacgtggccggatacgctgaccgatcaggtttatgcgaacaggttaactgttatcacaggctggatatccatccagccttttttatgctataaacagtgctgtttgagtgataaacacaatgctgaacttaatgtttatccccaaaataattggcgtttcgagccggtaggcagcaaacaaatcccgatgaatctatttattttaaggtcaaacgaccagtatattttaaggtcaaacgaccagtaagtgattcgggtgaatgaatgccgctaaccacgcagtagcgtcaattctgaaggggattgtgggcaaggagagaatcaacgtgataggccgtctcagaggtatcattctggaaaaacagccaccgctggtgctgctggaaacaaacggtgttggctatgaagtccaattaccaatgacctgcttctatgagttacccgagttggggcaggaagccattatcttcacccagtttgtggtacgcgaagatgcgcagttactgtatggcttcaataataagcaggagcgggcgctgttccgtgaattgatcaaagttaacggcgtcgggccaaaactggctttagccattctctccgggatgtctgcacagcaatttgttggcgcagtcgaacgtgaagatattacaacgctggtaaaactgccgggtgtcggtaaaaagaccgccgagcggttagtggtcgaaatgaaagatcgctttaaaggccttaacggcgatctgtttaataataccggtgatatctcgttaccaacggcttcgccacaaacctcggatgctgatatcgaagcggaagccgcttctgcactggtcgcgctgggttataaaccacaagaggccagccgtttagtgagtaaaattgccaagccgggtgccgattgtgaaacactgatccgtgatgctctccgtgcggcgttataatgccgccgatttatagaatgaattgtgttatatacccaacgttattgacgttgtagagagctggcaaacgaatccgatgaatttaaaaaaattagtcattcgggtgaggggcgtagttagcctctgcggcttcaaattcaaagggtatgaaggggtaagggatgattgaagcagaccgtctaatatcggccgcagttatcaatgatgaagagagcattgaccgggccatccgccctaagctactgactgaatatgttgggcaacctcatgtccgtgaacagatggaaatcttcattcaggcagcaaaacaacgcggtgatgcactcgatcacgtgctgatatttggccctccgggtttgggtaaaaccacgttggcgaacattattgccaacgagatgggggtcaatctgcgcacaacgtccggtccggtattggaaaaagccggtgatttagccgccatgttgaccaacctggagccgcatgatgtgctatttattgatgagatccaccgtttgtcaccggtagtagaagagattctttacccggcaatggaagattatcaattggacatcatgattggcgaaggccccgcggctcgctcaatcaaacttgatttaccgccgtttaccctgattggtgcgaccacccgagcgggttcactgacatcacctttgcgtgatcggtttggtatcgtgcagcggctggagttttatcaggtggctgatctagagcatattgtttcacgcagtgctaagtgcttggggctggaactcacgccggagggggcacaccagttggcacgtcgctcaagaggaacgccgcgtattaccaaccgcctattgcgccgtgtacgtgatttcgccgaagttagagccgatggtgccattaacggtgaggtcgcaatgaaagcgctggatatgcttaatgtcgatgctgaagggttcgattttatggaccgtaaattgttgttagcggttatcgataaatttatgggcgggccagtagggctggataatctggcggcagcgattggtgaagagcgggaaaccatcgaagatgttctggagccgtatctgattcaacaaggctttattcagcgtactcctcgtgggcgaattgccacaaatcacgcgtataaacattttggtattactcgggaagaataatacgtttcacgctgtgggggttatagacctaaaccccacagcgtgaagtgatgactatcctcgtgctttttgcgacaggctcagcacaaacatggcggcagcacagagcacaacggaaggcccagctggggtatcatagaaggcggagaatgttaaaccccctgtaaccgcaaggataccaatccctacggcaatcccggccatttgctctggcgtgcgggcaaaacgacgggctgctgcagccgggatgatcaacagtgaggtgataattaatgcacctacaaatttcatcgataaccctatcgtcagtgcggtaaccagcatcagtagcatccgtacccgctctaagttaacaccatcaacatgggcaagctccgggctgatggtcatggagagcagtgcccgccattgccagaacaagactgctaataccaccaccacaccggctgcaataagccagatatcactcagcgtcacggaaagcaggtcgccaaacaagtaggccatcaaatcaacccgcacatttgacatcaaactgaccaccaccaggcccagagataatgcgctgtgggccataatacccaatagggtatcaaccgccagttgtgggcgacgctcaagccaaaccagaatcaaagccaataccatagtcatcgcgatgacagcataaaacgggttaacatttagcagcaaaccaaacgcaacaccaagcaatgaggcatgagctaatgtatcaccaaagtaggacatgcgacgccaaacgacaaaagaccccagcgggccagcggctgttgccagtaatacaccagccaaccaaccgggtaacagtaattcaatcatgcgccacggctcccgctgtttttcaaaataatttttccatgcaagtcgtgacgatgattatggttatgacgataaacggctaactgctcggcaccacgattaccaaacatggcaataaactcggggtgggttgaaatcacctctggtgcgcctgaacaacagatatgttgattaaggcacaatacttcatcagttttggccatcaccaaatgcaaatcatgggaaaccattaacacagcacaacctaactcttttcgtagttgttcgattaaatcatatagcgctaactggccattgacatcgaccccttgcgttggttcatccaacaccagcaactgtgggcggttcagtaaggctcgggcgaggagcacacgctgattttcaccgcccgaaagcttttgcatgggttgatccagcaaatgagcggcctgcacccgtgtgagtgcaggcagaatgtcggcttttttcacccccggctttagccgcataaagcggctgacagttaggggcaatgtggcatctaaatgcaatttttgcggaacataaccgatgcgtaagccaggctcacgaaccagagatccactacttgggggaataaggccaagaaccacccgtaccagtgtggattttcctgcgccatttggcccaagcagcgtaaggattttccctgggcgcagagaaagggaaatatcgttcagtacccggcgagagccaaaagtgacggatatcttattaagcgttaccaatatgggcatcatgattatatttgcagaatctagtgaatgttataatattacgctttacccatcaaaacgtcgagaattcgtattatgttacataaaaataaatggctaaaacaggcaatgctcgccagcgcacttttactggcaaatccctttaatctggcttcggcggccgttgttacatcaatacgcccgctaggttttattgctgccgccattgcagatggggtgctgccaaccgaggttttattacctgatggcgcatctccccacgattatgcgcttcgtccatcggatgtccagcggttacgtagcgccgaattggttatttgggtcgggccggaaatggaagcatttctatcaaaaccattaacgcaagtcgctgaaaataaacagatcgctttatcacagttaccttctgttacaccattgttgatgaagagtgatgaacatgatgaggctgaagagggcgagagtggacatcatcatgatcatgctaaagataatccgactgatgaccaccatcacggtgagtataacatgcatatttggctgtcaccggccatcgctaaacaggctgcaattgctatacacgacagattattggaacttacgccacaaaataaggacaaattagatgcgaacctgcgtcgattcgaggatcaactagcgcaaaatgaaaaaaatattgttactatgcttaagcctgtccaaggtaagggatattttgtttttcatgacgcctatggctactttgaaaatcactttggcttgagcccgttagggcattttacagtcaatcctgaaatacaacctggtgcgcagcgtttacatcaaattcgaacacagttggttgagcataaggcggtatgcgtttttgctgaaccacaattcaggccagcggtcattaatgctgttgccaagggaactaacgtgcgttctggcacactggatcctttagggagcggtatagtattggacaaggacagctatgtgaactttttgtctcagttgtcgaaccaatatgtgagctgcctgaagtaagattaaaaggatactcataagtgcagcagatagtcagaactatcactttagcatataacaatcttcctcgaccccatcgcatcatgttggggtcgttgactgtaatgacactggccgtcgctgtttggcggccttttatctatcacccagagcatgaacctgttgccaagagcgttgtgctagataccagtcaatcccgcattttattgccagaagccagtgaacctctcgatcagccaacgcctgacgatgcaatcccacaagatgaattagacaccaaagatgccaatgacactggtgtccatgagtatgttgtgtcaacgggtgatacgttgagcagcattcttacccagtatgggattgatatctctgatgtttctttattagcgaaccaaaaccgtgacttacgtaatctgaagatcgggcagcaaatctcctggacagtgaatgacaccggtgatttacaaagcctgacttgggaagtgtcgcgtcgcgaaactcggacgtataaccgtgttgggaacaatttcaaagagactaaagagctgcagaaaggcgagtggaagaacagtgttctgacgggccgtcttgatggtagttttgtcggcagtgcgaagaaagcagggctgacagccgctgaaattcgtgccgtgaccaaggcactacagtggcaattagatttcagtaagctgcgtaaaggcgatcagtttgcggtcttaatgtcacgggaaatgctggatggtcgcagtgagcaaagccagctcgttggggtacgcatgcggtctggaggtaaagattattatgctatccgggctgaagatggcaaattctatgatcggcagggctctggccttgcacgtggtttcctacgtttccctacactgaaacaattccgtgtctcatccaattttaaccctcgtcggttaaatccggtgactgggcgtattgcgccgcataaaggcgtggatttcgcgatgcctgtcgggacaccggtattagccgtgggcgatggcgaagtcttaatctcaaaattcagtggtgctgccggtaactatgtggttatccgccatggtcgccaatacaccacgcattacatgcatttgaaaaaattgctggttaaacccgggcagaaagtaaaacgtggtgaccgtatcgcgttgtcgggtaataccggccgttcgactgggccacatctgcattatgaattttggatgaaccagcaagcggttaatccactgacagctaaattgccacgttcagaagggttgagtggtaaagatcgcagtgagtatttggccattgttaagcaagttattccgcagttacaactggattagcagtgataccgtcaggttagcctgtcggtgtgtttatccctaagctgccagtgagttgagcactggcagtttagtttcagtctgtcagcccatcgtagatggctgatatcagttttttgctattgggctttaattgcgaagcggttatctgcaaacactgaattaaacgttgtcgcctggaaagatgaaggttgccaaaaagagtgtctgtataacgtgtcttctgtaatgatgattagcccaccgccaattctaagagtttccccatgcacaaagaaaaaaatgacgcaactggttttattccggtatttcagaaaaccttcctccatccgcgtttctggggggtttggttaggtgctggagcgattgcggcgctcgcttatattccacccaaattccgtgatcctttattagctggcatagggcgtctcgctgggaaatttgctaaaagcgcccgtcgtcgcgctcgtattaatcttctttattgtatgcctgagttacccgagtctgaacgcgaacacattattgaccagatgtttgctaccgccgctcaaccgttaatgatgatggcagaactttgttttcgtgatccgaaaaaagtgctgactcgcgtgcactggcatggacaggaaatactggatgagctgcaacaacaagagcgtaatgttattttgttggtcccccatgcctggtccattgatattccggctatgctgctagcggagcagggcaagccagttgcaggtatgttccatcatcaacgtaatccattggtggactatctatggaacagtgcgcgtttacatttcggtggtcggatccatgcccgcgaaagtggcatcaaaccttttatcagttcagtacgccaaggattctggggttactacttacctgatgaagattatggtcctgagcaaagtgaatttgttgatttcttcgcgacctataaggcgacattaccggcaataggccgtttaatgaaagtctgccgtgcggccattgtaccgatgttccctgtttataattatagagagcatcgtcttgatatctatatccgtccgccaatggatgatttggcggatgctgatgacgcctatattgcccgccggatgaatgaggaagtggagttgttggttaagccgaatccagagcaatatacatggatcttaaagctgttaaaaacccggaaagagggtgaaaccgagccctatgtgcgcaaagatctttagggtgtgataaccgttcaagagggcggttaaatacagcaccattcaatgtaaaacgagtaaatacaaacacggcgaaatataaaacagttaaaggtaaaaggcccgctagtgatagcgggcctgaggttattgacaaagtgcccgcgacggagagaacaggcagatcgtaaagacgccgtaaatacatccatgtaggctcgagccgcgccatccttggcgcggacgctttactcctctgcctatcctcaccgttcaagagtgagtcatcggggtttgtcagcagtctgaggcccgctagtgatagcgggcctttgcttttctgcctatcttaaaaataacttattcgacgcggatgatacgactggtattggtcgtaccaatggtgcccatcacatcgccctgagtaacgataaccaaatcacctgacaccaggaaccctttatcttgcaagcgttttactgcttctgtggcggcaagaacaccgtcagtatggggatcacaatagaccggcgtcacgccacgatagatggcggttaggtttaaagtatgatcatggcgcgacatggcgaaaataggtaaaccggaactgatacgcgacatcatcaaagccgtgcggcctgattcagtcatggcgataatcgcggtgatacctttgaggtggtttgccgcatacatggtcgacatcgcgatagcttcttcgacgttatcgaattgcacatctagacggtgttttgacacattgatgcttgggattttttccgcgcctagacagacacgcgccattgccgctacggtttctgccgggtactggcctgctgctgtttctgctgacaacatgaccgcatcggtaccatccagcactgcgttggcaacatccatcacttctgctcgggttggcatcgggttggtgatcattgactccatcatctgagtcgccgtgatcacggcacggtttagctggcgggcacggcggatcagtttcttttggataccaacaagttctgggtcgccaatttcaacacccaaatcaccacgagcgaccatgacgacgtcagaggccagaatgatatcatccatcgcctcatcagtggcgaccgcttcagcgcgctcaacctttgcgacgatctgtgcattgcagccagcatcacgggccaggcggcgtgcataatgcaaatcttcaccagtacgtgggaaagagaccgccaggaagtccacaccaatttttgcagcggtaacaatatcggctttatctttttcggttagggcttcggctgataacccgccacctaacttgttgatgcctttattgttagagagcgggccaccgacggtcacttcggtgaagactttcatgccctgaacttcaaccacttttaactgcacgcggccatcatcaagcaataaaatatcaccgggaaccacatcagctggcaggcctttgtaatcgatacccactttgtttttatcaccttcgccttttgccatattggcatccagcaggaatttatcgtttatattaaggaaaactttaccttctttaaacgtcgatacccggattttaggaccttgcaaatcaccaagaatagctacatgacgccccagtctggcagcgatttcacggactttattggcccgtaattcatgatcttcagcgctaccatgggaaaaattcaggcggactacgttcgcacctgcagcaataatcttttccagattattgtcgcggtcagtagccggccccagtgtagtaacaatcttggtccttctgagccgtctggacatctcttactccgttgactggtgaagcatggtgttgttaaaacagcggataatggatccgatggtaaaatgtcattaatctacaaattttacgataaaatcgtgtcaagcatgttatctgctggcggatgtaaaaacgacctattgcacaaacgagctattgtacaaacgatctattgcacaaaccgattggttatgggaagccggctgcacaaaaacatgagtgacaaagcaaactcttgctctcaattattggcctgatgaccctctccgggccatgacgacgattatctctcaataatacgtcaagttattacgacaaaagatgcgctaacacaaggcaacgtgacttccgctcatgatgttaatcaccgttgtttactggcaaagaatccttatcaaaacgagattctttcaatgcctctttgacccgcttcaaattatccctaaattttgctccgcgccgtagggtgaagcccgttgccagcacatcaatcaacgtgagctgggcgatgcgtgacaccattggcatatacatatcggtatcttccggcacatccagcaacagcgataaggttgcttcgttggccagtggcgtatcacatgaagttatggcaatcacggcagcatcattttcacgagccaactgcgccagctccaccaggcttttggttcgccctgtgtgggagatcaacactaccacatcgccttcgcttgagttcatacaactcatgcgttgcataacgatgtcatcgaaataaattaccgggatattaaagcggaaaaacttattcatcgcatcatgagcaacggcagcggaggaacccaggccaaagaacgagatttttttcgcttgagtcaataaatcgacagcccggttaatggcggcgatatccagattgttttttacgcggtccaagctggccatcgtcgattcaaaaatttttccggtgtacgcagctacactatcatcttcttcgacgttacgattcacatagggtgtaccgttcgccagactttgcgccaaatgcagtttaaaatcagggaaacctttggtctccagacgacggcaaaaacggttgactgtcggttcgctgacattcgccattttggcaagtgtagcgatactagaatggatggccgtttgcggggaggcaaggattacctcggcgactttcctttctgatttgctcagaaggtccatactattttggatattttccagcgtattcatataacgagagccacccatgggttttaccgatttcatataaaggagaaatctatgccggtttaatgaaaatatactacgagctggtacccgttggcagtggcatagggtgagaagtaagcctttttcaccataatatgacctgtgtctaattttcataatggtaaatggttatcaaaaacgtcataaaattacattttaacgtcgcttggcctgatttggcgcggcctcacgctcggatggatgttttttgaccttttttgacgcatttttatctgggtttactggctatagtcaaagagagtacattagtaatgtaagaaaattacaaatatcctgcaacgaggagaatagcatggcagtaatgaatacagtccaggtagcccaggcgtgtgacctggtgattttcggcgctaaaggtgatttggctcgccggaaactgctgccttctctttaccaattagaaaaagcgggtcatatccacccagatactcggataatcggtgttggccgtgctgagtgggataaagatgcgtacaccgctgtggtaaaggaagccctcgatacctttatgaaagagccgctggatgacgagctatggcaaaaactcagctcgcgcctcgacttctgcaatctggatgtgaatgacagtaagcatttcaccaaattaggtaaaatgctcgatcaaaaacatcgcaccacgattaactactttgctatgccgccgagtacatttggtgcgatttgtaaaggcctgggagaagccgggttaaacaaagagcctagccgagtggtaatggaaaaaccattgggaaccgatttagcgtcctcaagggtaattaacgatcaggtagccgagtatttcaacgaatgtcaggtttaccgtattgaccactatttagggaaagaaacggtattaaacctgttggcgcttcgcttcgctaactcgttgttcgcctcaaactgggacaaccgcactatcgatcatgtgcaaattaccgtcgcagaagaggtcggaattgaagggcgttggggctattttgatcaggccggtcagatgcgtgacatgatccaaaaccatctgttgcaaatcctgacgatgatcgccatgtcaccccccgcagatctcagtacggatcgcatccgtgatgaaaaagtaaaagtactgcgttcgctgcgccgtattgatcacaccaatgtgcgcgaaactacagttcgtgggcaatatactgccggctttgtacagggcaataaagtgccgggttatctggaagaggaaggcgcgaataagaatagcaataccgaaacatttgtgtctattcgggtggatatcgatgactggcgttgggctggggtacctttctacctgagaaccggtaagcgcctacccagcaaatgctctgaagttgtggtttactttaagaaccccgcactgaatctcttccgcgaatcttatcaacaactgccacaaaacaaactgacaattcgtctgcaaccggacgaagggatcgaaattgaagtgctgaataaagtccccggattggaacataagcatcgtttacaaaccactaagcttgatctcagtttctccaaaaccttcaatgagcagcatattgctgatgcctatgaacgtctgctactggagaccatgcggggtattcaagcgctgtttgtgcgccgtgatgaggtcgaagaggcgtggaaatgggtcgattctattatgaatgcgtgggcggcagataatgaagcaccaaaaccataccagtccggtacatgggggcctgtggcatccgttgctatgatcacccgtgatggccggtcatggaatgagttcgagtaatcgctaaccgcacgataatagcgcgccaccagaggcgaatctgatggcgcgtgactgccagggagagcagggggcagcctgcgtaataataaagagcgagcagttggctcataccctattgattctttatggcaaacgggatcgcagttgttccatcgggagcggcgatcagagtgccatatttcaactaacaccttcgggtgagtacaatgccagtcggcataagtggagataacaactaatgaaaagctggaaaacgagcgcagaacagattatgaccgcaggtcctgttgtcccggtgatcgtggtcaataagctcgagcaagcagtaccgttggcaaaagctctggtggcaggcggtgttcgcgtactggaagtgacgttgcgtaccccttgtgctgtggaggccatccgcgcgattgccaaagaagttcctgaggcaattattggtgctggaaccgtgcttaacccacaacaactggctgaagtggttgaagctggcgctcagtttgccattagccctggtttgactgatgaactgcttaaagcggcctgcgaagggtctatcccattgattccaggtatcagcaccgtttcagaactgatgctggggatgagctatggtttgcgtgagtttaaattcttcccggctgaagctaacggtggtgtcaaagcgttgcaagccattggcggcccattctcgcaagtccgtttctgcccaactggcggtatcacaccgaataactaccgtgattatttagcactgaagagtgtattgtgcattggtggctcatggttggttcctgctgacgcgttggagagtggtgactacgcgcgcattactgaattagcgaagcaagcggttgaaggtgcggcagcataagccgctctaactccctgacataacgggagaatccgtatattttcaccaaagacagagcctctgcattgcaggggttttgttttttcagaatcgctaacttattattttttaatctcttttatttaactatttataaaactgatggtttgctttataaaattgactgtggtaaaaatataacagttaattattctaacttcatgagggttttaggcgtatcacactgggtttggcgagtgagtctgtcgctaaaacacgtgtagccaaaaaaaagagatatattatgatgaaaattaatggaattactctcaaaacttctatatgccaactcttcctgtcagccatcctggccagtgagcatcactggtgcagcgagctatagcgtctctctcctaaaatccggtgcgttaacaagttagcctattgccacggtttggtttattgggtctattgccatggcttggcttattggcatcctcgttaatgttattttccgtgaagaatgttttggtcagtacaaataattgtcatcaatgttattgggtcacctgagtcctgataaaagcaagtctcccggaaagctgttttatacgccaagtgagtatctatttcttacggactgcgcaggtttattccttgtgaataaggcactgaagcaggatagccgtaacaaatagaccttagcgtgcgtttatgcgtgttaggagaagaaaagtgatttattggatatttttaggtctggcaattattgctgaaattattggcaccctatcaatgaaatatgccagtgttagcggcgagatgaccgggcatgtcgtgatgtattttatgataacgggttcctatgtcatgctctcgttagcggttaagaaagtagcattgggtgtggcttatgcgctgtgggaggggatcggcatccttattattactattttcagtgtgatgtggtttggcgagacgttatcgccactgaaaatagccggtttagtgacactgattggtgggatcctcttggtgaaatcgggtacgcggaaaccaaaacaaccgaaccgccatcgcggtaatcgacccccttcggtacagggattaaaaacacagactaccggccatcataagggtgttgctgttgagtcaggtgagcatcatgcagcagcttgagttttaccctatagctttcttgatcttggccgttatgctggaaatcgtcgctaatatcttgctgaaaatgtcagatggctttcgccgaaaatggttggggatattgtccctgttgtcagtattaggcgcattcagtgcgttggcgcaagcagtgaaggggattgagctgtcggtagcttatgccatgtggggcggttttggtattgcggccactgttgcagcgggctggattctgtttaatcaacggttgaactacaaaggttggattggtttgatcttactgctggcgggcatggtgatgattaagttgtcatagcggggccagaggcagtaagcggagggtagcctggcggctactctcctttgtttttgtggcttagtgacattggttacttagtgacatttatcgtttagcaacatatatcactcaactacatctatcactcaactacatctatcactagctacatttatgaacgaatcatattgcagcaatgattttgatttcgactttatagtccggattcatcagtttggcttcgaccgtacagcgaacgggcgcgttgccgtcaacaacccaggcatcccaagcggcattcatacccgcaaagtcagctttatcggccaagaaaatggtggcatccagaacccggcttttatccgagcctaattggtgcagcatcatatcaatggccgccagggtattggcggtctgggcggtgatatcggcatccagattttcaggtacgctggtgtaatagatagtgtcgttgtgtatcacagcatctgaccaacgtttctccggattaattctctcaatactcatttttactccattttgtgagggtcaatgtcagttatgtacgaagggtatcatagcaaggaaagagaatgtgtggtcgtagagccattggcttggcataatcagcgctgatttcgcccggcagagagacagagtgatagacgattttgcaacagacggcgcattagcgcaggctattaaaggttttaatccccgtgagtctcagcgccagatggctgcggcaatcagtgaagccattgatgccaaacagcaattggtggtagaagcgggtaccggtaccggtaagacgtttgcctatttagctccggcgttgcgggctgattgcaaagtgatcatctccaccggctccaaggcattgcaggatcagctctattcccgtgatcttcctatgatggtgaccgcgctaaaatacaaaggcaaattggctttattgaaaggccgttcaaactatctttgcctggagcgccttgaacagcagtcattggcaggcggggatttagccagtgagacattggtcgatttggttcggttacgtggttggtcagcagagacggttgatggtgatatcagcacctgtggtcaggttgcggaagacagttttgtctggccactggttaccagtaccaatgataattgtctgggtagcgattgcccgctgtataaagattgttttgtggtgaaagcccgtcgtcgggcgatggatgctgatgtggtggtggtaaaccaccatctttttctggcggacatggtggtgaaagagagtgggtttgccgaacttattccaaccgctgatgtgatgatttttgatgaggctcatcaaatccccgatattgccagtcagtattttggtcaacagctcaccagccggcaactgatggatttagcgaaagatattattattgcctatcgcaccgaggtgcgtgactccgcccaattacaaaaaagtgcggaccgtctgacgcaaagtacacaggattttcgtttagtgctgggcgatcccggttaccgtggcaacttgcgcgatgtgatggagcaacctacggttcaacgagcgttattgttacttgatgatgctctggaactttgctacgacgtaatgaaactctcgcttggccgctcggcaatgctggatgccgccttcgaacgcgctaccgtttatcgtaaccgcctcaagcgattaaaagatgtcagaacccccggttacagctattggtatgagtgtaattcacgccatttcgtattggcgctgaccccgttgtctgtttctgatcgcttccgggagttgattgaggaaaaaccaggcacctggatttttacctcagcgacactctcggtgaacgatcaattgtcgcatttcacgttgcgcttagggctaactcacgccaaaaccttgttattacccagtccgtttgattatgccaatcaggcgttgctctgtgtgccgcgcaatttaccctccgcaaatgagccgggggcggctcgcaaattagcggtgctattaaagccgctgattgatgcaaaccaagggcgctgtttcttcctgtgtacttctcatcagatgatgcgtggattagctgaggagtttcgcgctagcatgacattgcctgttttggttcaaggggagaccagtaaagggcagctcttggcgcaatttgtcgctgcgggtaatgcgctacttgtggcaaccagcagtttttgggagggggttgatgtgcgtggcgatgccttgtcatgcgtgattatcgataagctgccatttacctcgccggacgatccgttgttaaaagcccgcattgaggattgccgcttacgcggtggtgacccgtttaatgatgtgcaattaccggatgcggttatcaccctcaagcaaggggtggggcgtttgattcgtgatattgatgatcgcggtgtgttggtgatttgcgataaccgtttggttatgcgtccttatggcgcgatgttcttaaatagcttacccccggcaccccggacacgggatctggcgaaagccatcgcctttctcaagcagcgcgattaaaagtaaagaagagtggggtgtgctactatgcgcgccctgtaaatacatatttatttcctgccgaggttggcatgtctacgcgaattttagcgatcgatactgcgacagaagcctgttctgttgcactttggaacaatggcgaagttcaggctctgtttgaactttgcccccgagaacatacccagcgtattttaccgatggtacagcagattctggcatcatcaggcttgtcgcttcagcaattggatgcgctggcttttggccgcggccccggcagttttaccggcgtgcgtatcggcattggtattggtcaggggcttgcattaggtgccaatttaccaatgattggtgtttctacgttgcaaaccatggcgcagggggcgtttcgtctgactggtgccacacgggtcttggcggcgatagatgcccgcatgggcgaggtctattggggggagtttgagcgtaatgcggaagggcattggctgggtgagcataccgaagccgtgatgacacccgcccagacgttggtacgcgctgaggcgcttagtggtcactgggccacggtgggaacgggctggcaggcttatcctgatctggttagtggcagtgatatcgcactggttgatgggcaaatgtcactgccacaggcggaagatatgctcccactggctttgtcatcatgggctcggggtgacgcggtcaaagttgaacaggctgaaccggtctacctgcgtaatgaagttacctggaaaaaactgccaggtcgctaaaactgagcgacatgctacggtgtctagagcctgaaattattatcttagaactgaaacttattatattagaaccgaaaaagattgtgtttaaggtctaaaattattaatacagctaaatgataaggggtagaaagctatggcgatgaatacgtcaatgactcagtctaagaaatttagaaatcataaatggatgtatggttggctaggtttgggggctttgctactttcaggttgtgtgacgataccgcctgccattcagggaacgacggcgacaccgttgcaagatcttaatctgatcagatcagctccaaagctatttattggtcaggaagcgcgctttggcggtacggttgtcaacgttaaaaatgaaccgaatcgtacccgcttggaaattgctagcgtaccgctggattcaggtgccagacctatcttaggcgaaccttcacaagggcgagtgattgcttatgttgatggttttctggaaccggttgatttccgtggacatttagtgacagttgttgggccgattgtcggggttgaagccggcaaaataggcatgacgccttataatttcgtggtaatcaaggcgaccggttacaaacgctggcatattgctcagcaagtgataataccgccaacatttgggccatggggctaccgacctgcggatatgtgggggccaggatggccgggttggtacaatccaggcccagcagagatacaaactattgtcactgactagctaattttgggccacaaaaaggcgcggagtccagcgcctgaggttattgacaaagtgcccgcgacggagagaacaggcagatcgtaaagacgccgtaaatacatccatgtaggctcgagccgcgccctccctggcgcggacgctttactcttctgcctatcctcaccgttcaagagtgagtcatcggggtttgtcagcagtcagaggcgctgagtccagcgccttttctatatctacatcctatacctaatatctgcatctatatcttataggtatgctgccttcgttgattaaatacaccattattgtgcgattaaatgaatcgcatcgtgctggttaacagagcgccgcttggagtggctagccaatcaggtattttggcacggagttcgatttaaaagagagtataatcaatcggttatattatctaatattaaatattttacctaattatttgattttatttatttttattgattatttgggccatttttttttattttgagaaactcagcgccaaaaaatagtgatgtatatctcaacctcaaaattgtttaaaaacaaactggtaagctgagttaaaatattgttaatgttctgatgtgaatttgcgttttaccatggcgaccaataataattttaggagtgttaccttggaaaaagtatggctaaagcgctatccggcagatgtccccgcagagattgatccggaccgctattcatctttgatagaaatgtttgagaacgcggcgttgcgttatgcggaccaacccgcatttattaatatgggcgaggtcatgacttttcgtaagctggaagagcgcagccgtgcttttgctgcctatctacagcaaggtctggggttacagaaaggtgaccgtgttgcactgatgatgccaaatttactgcaatatcctatcgctttgtttggtgttctgcgggcaggtatgattgtcgtgaatgttaatccgctgtataccccgcgtgaacttgagcatcaacttagtgatagcggagccgtggccatcgttattgtttccaacttcgcccacacactggaaaaagttgtctttaaaacccaggtccggcatgtgattttgacccgaatgggtgatcaactctcggcagcaaaagggacgttggttaacttcgtggtgaaatacattaagcgtctggtgccgaagtactatctgcccgatgccatttcatttcgtaccgtattgcaaaaagggcgtcgaatgcaatacgtcaaaccggatgttatcaacacggatacggcattcttgcaatataccggcgggactacgggtgtcgcgaaaggtgccatattgacacaccgcaacatgcaatcaaatctggaacaggcaaaagcggcctatgcaccgttgcttcaacctggccgtgatttggtggtcacggctctgcctctctaccatatctttgcattgacggtaaattgcctgctatttatcgagttgggggggcgcagtttattgataaccaacccacgagatatccccggtatggttaaagaactgagtcgttatccatttaccgcgataacaggggtcaatacgttatttaatgcattattgaataatgaagagtttacccatttggatttctccaccttgcgcctttcggtgggcggcggtatgccagtgcagaaagccgtggccgaaaagtgggaaacgctgacgggtaagcatctactggagggttacggtttgactgaatgctcacctttagttaccggtaacccttatgatctgaaacattacagcggcagtattggtttaccggtaccttcgacagatgttcggctgcgcgatgatgatggcaatgacgtagaattaggcaagccgggtgaactatgggtgcgtgggccacaagttatgttaggctattggcagcggccagatgccacggatgacgtcctgaaagacggctggctggcgacaggtgatattgcgacgatggatgaggacggtttcttgcgcatcgttgaccgcaagaaggacatgattctggtttctggttttaacgtctaccccaatgagattgaagaggtggtagcgttacatgcgaaagtgctggagtctgctgtgattggcgtgcctaatgaggtctccggcgaggcagtaaaagtctttgttgttaaaaaagatgcatcactgacacctgaagaattactaacgcattgccgtcgctaccttaccgggtataaagtaccgaaaattgtagagttccgtgacgaattgccgaagtcgaatgtgggtaaaatattgcgcagggaactacgtgacgaagaagttaaggtgggtacgacagacgcagcttaacttgacggagtcactaaatcatcaacaacgccggttatcaccggcgttgttgtgtttgttatcgaactatagccaatagattttaagaaacaggaaggcggtagctaatagacctgccacttgaaagataacggatataacgaccaagagaatgacgttttgaattatcagttgatcacgaccaataacgcattgcaacaggtctgcgaacaagcccggacacatgctcacatcgcgttggatacagagtttgtcagaacgcgcacttactaccctcagttgggtttgattcaactgtatgatggtgaacaactctcacttatagatccattacctatcacggaatggcagccttttcgcgcgttactgcaagatctgaatgtggtgaaatatttacacgcaggcagtgaagatctcgaagtgtttttaaacgcttttgaccagatgccaaccccgatgattgatactcaggtattagcggcattttctggccgtagcctatcctgcggctttgccatgctggtggctgagtttgaaggtgttgagttagataaaagtgaatcacgtacagactggattgcccggccgttgagtgaaaaacagtgcgattatgcggcggctgatgtgttttatcttttacctctggcggctaaattagtcgaagccactgaggcggcagggcggatggacgcggcgaaagacgaatgtctattgctgtgccgccgtcggagtgagacgctcgatcctgaactggcttaccgtgagattaccaatgcctggcaactccgtggccatcaactggcatgtttgcagaaattagccgaatggcgtttacgtcaggcacgggagcgggatttggcggttaactttgtggttagggaagagcacctgtggcaagttgcccgctatcaaccaacatcactcggtgagttagattctcttggcttgagtgggcaggagatccgctatcacgggcgaacattgctggcactggtcgccgaagggaatgccgtccctgaagatcagcttcctcccccgattgctaacttgattgaccaaccggggtacaaaaaagtctttaaagatattaaagccttgattcaatcggtcagtgaacgtagcggattaagcagtgaattactggcatcacgtcgccaaattaatcagttactcaattggcactggaagttgaagctttcagatgctcaacctgaattattaacaggctggcgtggcgatttattgtcttctgaattgcttgaaatcttacaacactattaatcagttttgatattaatcagccttcagggtgggatattaattccacgctgaaacttttcagttttaatttatgaacactctttttaatttataaacaatctgatgaattaaagattaagactttctcgttagggattcgtgtcaatattctgttagtcttatgatgctgggtatatatacagtcaattgagaataacgcccctgtaaataaatacaggggcgttattgagaagaaatcatttaggcgtttcttccgtttccggtaatgtcacgttaagttcaagaaccgaaatatcatcccctttctgctcaaattgcacatgcagcatttcaggatcgatctggatatatttacaaataaccgccaaaatatcgcgcttcaggtcaggtagataatggggttcgctatccccacggcgacgttcagcgacgataatttgcagccgttccttggctatattggctgtcggttttttgcgggacagaaagaagtctaacaaagccatggtttatcccccaaaaaggcgtttcaggaagcccttcttctcttcttctacgaagcggaaggggcgttcttctcctagcaagcggtcaacggtatcttcataagctttaccggcatctgactctttgtccagaatcacaggctcaccttggttagaggcgcgtaataccgattgatcttctggtatcacaccgaccagagggatcctcaaaatatccaaaacatcttccatgctaagcatatcgccgcgattaacgcgcccaggattataacgggtcaacagcagatgttctttaattggttcttggctattttcggcccggcgagattttgatgacaatatgccaagaatacggtctgagtcacgaacagaggagacctcagggtttgtggtgataaccgcttcatcagcaaaatacagtgccatcagagcgccactttcaatacccgcgggagagtcacacaccacaaactcaaaattcatttcaccaagatcgtttaacactttctcaacaccctctttggtcagggcgtctttatctcgggtctgagatgcgggcaggatatacagattatcggtacgtttatctttgattaatgcctgattcaaagtggcatcaccttgaataacattaacaaaatcataaacgacccggcgctcacatcccataatcaaatcaaggttccgcaggccgatatcgaaatcgataaccacggtttttttacctttctgggccaagccggtagcaatagccgcgcttgatgtggtcttgccaacgccccctttacccgatgtaacaacaataatgcgtgccatgaaatggattccttgtcaaagggcttaatttaaaggttgtatagttaatgtattatcctgcagatacagacgtgcagcttgaccaaaatactcaagcggtatctgatcactcaaccagtactgcccggcgatagagacaagttcagcacccagatgtgtacaaaaaatctggcacttagcatcaccggatgctcctgctagtgctcggcctcgcatcattccataaatatggatattaccatcggcaattaattcagcaccggcactgacactgctaataacaatcaaatcgcaattacgggcataaatctgttggcctgagcggaccggggtgttgatgatacgcgtttgggtgggaacgttttccggcggactgatgaccggctctggagccagtttttggcctttaccctcactcaataatggcaaccctgcacgtgcaattgctcgtttctgacgctcatcctgacaaccgctaatgccgacaatacgcagacctgctgaagtgacagcctgttgaagatctttccagttagcaccgttaggtaacgttgcaacgttaatcacaacaggggcgtttttcagaaatgcgggggcttgatccaccttttcctgcaatgcctgacggattacctctggccgcgaatcatgtaaatgaacgaccgatagggtaaaactactgccttttaactcgattggcgattgtgacatctatcctgactcagtttcagctacgtttaatccccagaataccatgcggggaaccatattcggatgttcctaagcatgttatagggaatataaaaagaaatctatccgtatcaatatattgaaatcttaaagtcacaattattccaaactgataggaaattacagcataactttgggttattcgctagtcttgaccccctatatttagcgactcagccgctattttatgattgcatattttttcaacacttggttttactttacaaagggttgtctttgtctagggaatggggtgttttttatcaaatggggcgatgatatttgattgttatcattcttaagatggcgaaatagcgatattgacagccgtcttatcggcttagtcaaatacctcaccatatttatttgagagaaatctcattcattcatcggtgatccaaactacgctgacattgtggtgtttgaatggtggcaatcatcaatccataagcatctcttgacccgactaagcgtgttatagttgccagtgtgcctgtcttatcagacattgcagtggtatgaacggtactcactacccgaatcgctgatatgagttggctcggaggaggggcagccaccttgcaatgtgcgtcattttgggtgtcactacacagacttgtatcgaacttatcaaacattgaatttatcaaatattgaatttatcaaataaagagtccaaacatgctttgtgcgatttacagaagccctaaacgagatcaaacctacctttatattgagaagaaagatgatttttcacgggttcccgctgaattattagccagttttggcaagccacagtttgcgatgcttcttgcgttaaatgaacgcaagaccttggcgaccgctgatgtggagaaggtgaaaaatgcgcttattgagcaaggtttttacctgcaagttcctccaccgccggaaagtttactgaaaatgcacttgggtgaaaccaaagcataacgctaactttcgagtatcaaccacgtttaaattcagcatcactacattgaccgcagaggatgtaaatgtcgtgatgtgaaattcattggctttggtttttcagttcccagcgggtacggcttgaataaaggaatatattgatgaaagggtcagttacggcagtcatattggcgacagccatctcctttggttgcgtcagtaaaaacgctaaggctctcgtggcggggggtacctcgccacggtcaacatcaaaatctatgttaactccaggggctacggctagcagtacccccacgatgttatctcagcaagggcgtgatccgtctcagtttccagcttatgttgagcagttaaaagcgcaagccagggctaaaggctatacaaccgagaccttggatacggcttttgctaatattcattttgtcgatcgggtcatcaaatcagaccgtaatcaattagaaaagaaaatcacgctggatgattatctaaccagagtacttccgcgaaagagaattgagcagggtagagcactttatcaacgttaccagccgcagttatctcaggtgaacgcacaatatggtgtccctgggcggtatattgtcgcgctctggggtatggaaagtgcttttggtcaaattcaaggtaaagaagatgtgatttccgctttatctaccttggcttttgaagggcgtagggaagctttttttaccaaagaactgatggctgcgttggaaattattcatcaagggaaggttgacgacccccaattgagaggatcttgggcgggggcgatggggcaaagtcagtttatgcccagctctttcctgacgtatggtgctgacggtgatagtgatggaaaaattgatatttggaataatattgatgatgtatttgcttctactgctaattatctgtctactcaaggttggaaatctgaacagggatggggccaggaagtcacgttaccgcaagattttaatgtgaaattggcggggttggatgatgggcaagccaagagcattgcccaatggcagaaactgggtatcacgccggtacaaaacgcgcactttgctgaatctgctgcgcgtgcctgggtgatcattcctgatgatctaaaggggcgtgcttttctggtttatgacaatttccggacgatcatgcattggaatcgctcttactatttcgctattagcattggtatgatggccgatagtatcggtcaatagtctgtgtttgccacggttgtaagaccgttactcagtgtgtctattagggtataaattcaagagaggcagtatgtatcaacatagagactggcaaggggctttgctggatttccccgtaaataaagtggtttgcgtcggcagtaactatgccgaacatatcaaagagatggggagtactgcctctgtggagcctgtactgtttatcaaacctgaaaccgcattatgcgatatccgccaaccggtatcgataccgaaagattttggctcagtgcatcatgaaattgaattagccgtgttgatcggaacgccgttaaagcaagccagcgaagatagagtcgcacgggcgattgccggttacggtgtggcattggacttaacgctacgtgagctgcaggcaggttttaaaaaagcggggcaaccatgggaaaaagccaaggcgtttgatggttcttgcccgatatccggttttattcccgttgctgagtttggtgatgcacagcaggcagatttatcgctaacgattaatggggaaatccgtcaacagggaaatacccgtgacatgattacaccaattattccgttaatcagttacatgagccgtttctttaccttacgtgctggcgatatcgtgctgaccggtacgccgcaaggcgtagggccgatgcagtcaggtgatatgcttaaaattatgctcaatggcaaaacagtgaatacccgcataatataaagagaaacgtgccgtccgactttactgtcgggcggcaaaacttgcatctgtaagctaaagcgtctataacggcccgcttatttatttacaccggatacctatatgtcacaacctcctttttggcaacaaaaaacattggctgaaatgtcagatagtgaatgggaatcattgtgtgacggatgcggtcaatgctgtttgaataaactgattgatgaagatactgacgaaatttacttcaccaatgtcgcctgtgatcagctcaatattaaaacctgccaatgcagtaactatgagcgtcgctttgaattagaagaagattgcatcaagttaacgcgggaaaatttggtgacgtttgcctggttgccaccaacgtgtgcctatcgcctgattggagagggccatgatttaccccgttggcatccgcttttaacgggttctaaagctgcgatgcatggtgaacggatctctgtacgtcatatcgcagtacgtgagagcgaagtggttgattggcaagaccacatattgaataagccgagttgggctaaataacgcttaaggcagcatgtctaacttgctttagccgatgacagcctaagctgccatctttaccttcattgttatgatgatggattgttataatgatagattgctatgatgatagcgggtggtgagtggtttgcggccacttcactatcgctgtcactaactctaatgtggccaacgtagccagcacccagataaaccaaaccttgcctactgtcaccagtacccagcccccaaaaggcggaaaaccaaaaatacccacgaagtaggcaacgacaaaccaagtcagagcggcgtgacggttttcaggggccgattcattgaccgcccaagtttgaatcacggggtataacagaccgtagccagcgccggttagcatggcggcagcgatctggaaactcacatgcgtcggtattcctaacaggcacacaaggccgatcattaggcaacacaagagtaccgctacgagtggggtacggggccagcttgatagtttgtgtgcaagtaacaggcgtgaaaccacggcggtagtggcatgcacggcaaaaaaagtactggcgctggccaatgaaccgtcggtgagcgagtcctgaaacgacatcattccagaaaaaacggccccccctagacagaccatcacgatgggtctgatgactccgcttttggcgagtacggtaattttttttacccaaggccgcagtgaattctcatgccggataagtggctctcgggtgccaaaaatcatcaacaggatagaggcgaagacccccatcacgcccaccaacagaaatgcggcctggatggggatccctccttgtaccaccgcgatagtcagcaggatagggctaccacaaattccggtcatctggaatgcactgaagcgtgtaaaaccagggcctcgttcggtatcggtgaggcgttcagacagcgccattggccccccgatatagaacatgccccagcccaggccaatcaacagtgccgctacatggggcagatagccggatccgccactgaggctccccagtagaaagtagccacaggactggatcagtgctgccagcgccgccagacgtgaggcgtccaattttccagcaaaccagccaaccaaaggcacaccgatgagtgtcccgaacagagccataccgagggttgccccagcgtcaatgtcgttgcccccctgcgagtgaaaccaagcagaaatgagaaatgtggcaccatagcctcctgcgctgaacaacgtgccaaacaggagaaacagtgatgaagtttttcgcatgatttagactcctgtctcgtttgtggttgtagcagatgagagcggagccattgatctcagcattttcaccgtattttccagacgctggcagacataatctatttcactttcgttattaaaccgtccgagtccaaagcgcacactcccccggagctgctcatcactcacccctagagcctgtaacacgtgtgatggtgtctgttggtcggaggtgcaggcggatcctgaggacaaggcaacgtcagagagttcgagcaacagcgagtcggcatcgataccctcaaaggatacgtttaacacgccgggcaggcattcagtaaggtggccgttgacctgcatattcggtacggtatcgagaatgtgctgccgtagcctgtttcgtaaatcacatagcctggccgattctactgacatgttttccatcgccagttcggcggcgcgtccaaagccgacaatgcccggtacattgagtgtgccggagcgtaaacctcgctcatgccctccgccaacgatgagtggtgaaagcataagatgcggatcggcggtattgacataaagtgccccgacccccatggggccgtaaactttatgtgcggaaaaagtggccatactgatattcatccgttgcatatctaaagcgattttcccgaacgcctgtgtggcatcggtatgaaataaaatgcccttatcccggcagagtgcgccaatttctgccactttttgcaaggtacctgtctcgttgttggcagtcatgattgagaccagacgcgtatcgggccggatagcttggaagagggtatcaagggaaacaataccgtcacgctgtggctgcagataagtcacactaaccccactgtcggcaagtttggcacagcagtccagaactgacttgtgttcaatcatggaggtgatgatatgcccccaattcccctgatactgaaggcctaagatggcaagattgatggattctgtcgcgccagaggtgaagatgatatcggcgggactgactgcattgatagcggttgcgattaatgtcctggcccgttgaacagcctggctcgcttcccagccaaaggggtggctcttactggcggcattgccataagcgtgggttaggtatggcatcatcgcctgcaggacggcagggtctagtgccgttgtcgcgttattatcgagatatatcggtgggttctgactgtacataatgatttttccttaatcatgagcgagacgacaacggcttttttggggcagaggtgaattgagcgattatcttctccccccgactgacttcaccggcctcattgaccagattaaggcgaatggcggctgggacacctagcaagtggctgagctggagcccgcgaacataggccaggcttctggaccaagggctattttcaaagaacacttccagaaccgcttgcggatcctgatggtcgctcgctgcccgttcaaaatactctttggtgatagccgcacaggtgagcttttgtgttggcgtctcattatgcgtatcaccgtttggtcgtgaggctgctccggttagcatcctgcgggtgagcctttcaggaatatcttgggtcgcgaggatatggacaaggtgctgtcgggctgaatcttcgtggatcgcgcggatatcactgagatctatctgatacttttccgcaataggcagaaaaacctgctggattaacggatggagatggcttaggcgcgggcggcgtttttgggcgttagaaaggttttctgtcagaaactgaaggcgaaaaataccgaggtgatcgaacgctacggacaacttcggcagcaaatttccactatccagggattgtcgggcgagccgcagtgctgcatcaaaggcatttaattgagcctcaatggcaaccatgccgttattatcaagataaacacgggagttcccggcaagtatgccaatgtgagtgttttgttggtccatgtttctcagtttcctttgagtgatgacgtatttttctttatacaaaaatgagaatttcgtcttgtttatacgaattgaaaatatttactttcctttcagccttgtgcaataaaataacgactctaaatccggtgtaagatatacccgtatgcttaatcgccttctgataatcgctaatctataaaaatctgatgtgtaagaaatgacttataaagaagttactaattcggataacactttcaactaactgaacgtcactgatttttctattatacgcatggaaattatttcctcattaaaaaagctacttatatagataagtggggtgcctcctcggtaagaaatgaaataataatttcagggtgtattgtaaccttttgacttgtaagtaaaataaattaaaaaatacactttaccgaaactgaggtgcgtatcttaagaggttttggcaaactcatcgcaccaagattcggctctcttaggcaataggcttttttcgagacttaacaggcagcctatttatatcgtgtttaagttccctatcggattctgcagtgaaaaataaggcattataagagttgtggcaagatctttagtgaagcctggaaaataatttaataaatttgcagtaataggtcatcagtctgaatactttcttttagtggttgtagtaaatcgtcttctctgcttaaaaaaaggctattcccgcaaaggtgaattaattattaaccacatagtgatctttatgatttgttaaactgagtctgttttcttggctcggtaacccgttgcattcaacccaaatttttattggatgtgattggctagggtattttctttaatagattcactattcctgcgcaggaataatgattattaacatagccaacgcacatgcagcttgaagtatgacgggtagatattattggcaaggagagcgaggtagggcgaaaattgggcattgaggccttcggtgttaagggtcatgcatggagaaaaaggtgagaatatgtccttacccatggcggtttttacctgacgggccagatatggcatactaacgccgaaatttaactaagaaactgtataaaatgaaatattcaacgttagccgctgttatctttggcatttcagcgactctaagtagcgccacaaatccggtacaggctgccgaggcttccttaattaatcttgtttgccaattgaaagatggtaatgaccttttagccatattagatggcccgaatcagcaattgatcattgataagtcagtgtttcagtttataaaagtgaatccagaaggccaaggggaagcattaatatttcagaaagcaaacagtgaggagcaagtgatcgcctctctgaatatttctgcgttaccaatacgtttggccgtcgttgatgaggtgcaggctagccagtatacctgtacgcacacccaggcgtagattatccgcctttctctctgttcttacccagagaacattgactaatgaaactcagatcaacaggggatggaaaatctgttgatctgatttcaatccaatctgccgattgaattaattatctttaggatgaaaaaagttgccgcatctagggcaaacaagtgtgatattttttcgaaccttggcactgtcttgttctgagaccaaggcacactcagggcaagtgacatttattcttttactggagaaagatttaaacacatctaatagggacatgatttattaccgccaggatatggaggtaaattctaccatattttgcatggaattaagtgttcattaggattaacagaccgtttgaatctgatataaaaatggcgccagagaggcgccattgataataaagatatgtataaaaattatcggccgaacagatcgcgtcttttaggtttaacaaattggctgatcagaacgagtacggcgataaccagatatgcagcaaaaataccgactaaccattgtggcatttctaatgacataaactgccattgtctttccgagcaatcgccactggcggcgaacacggcgggtaaccatttatccaagggtagccatgaagggaagttgacgaagaaatcgcaggtgttaaatggggatggattcaactgcagcatagtgtgtgcccaagctagctgaacccctttccacgcgctgtagatccaaactgcaatagctaaatagcgtagtggtgatctcggggctattgcacccaatagtgatgcaccgagaataccgaataatgcgacacgctcataaatacacattacacacggttgtagcaacataatgtgttgaaaatagagcgcagttaactctaatagaaatgcagtcagggccattaatagccaagcaccgcgtcctcgggaacagcggttaaggaattgcaacatatctttattttccatgcagtaagcaattgtaccggcagtgtaaaccaattcatcttttctgccagctacccaaaagcaaaattaggtaaaaatcagttttttcccgcacaagacaggctatcacaagtacaaattttactttgggtgagatgttggttggttttgccagcccccattcgtgccaccttgagttgtcgcacttatccccaaggctggccaaccataatgcaagtgatcagtgtgggatggcaaccccgtttgtgatgtgtggcaaactgatccatccagcctgagtcagccactctgtcatcggtaccaataaaaactcgacacccagcaggccaacaatcgtcatcactagagtataaggcaaagccatatataccattcgcccataggaaaggcgaattagtggtgccaatgccgaagtcagcaggaacaagaaagcggcctggccgtttggtgtcgccacggaggggaggttggtccctgtattgatggcgaccgccaacaattcaaattgttgtaacgagacaataccatgctcaaacgcagaacgggcctcattgatatacacggtaccgacaaaaacattgtctgacaccgatgagagcaagccattaaacagataaaacagcgatagctgagcggaaggcgaggcttgtaaaacaaactgaataatgggggtaaagaggctttgttcaataataaccgcgaccacggcaaaaaatacggttagcagcgcggtaaacggcaaggcttcctgaaaggctttgcccaatgaatgctcatttgtgataccacaaaatgaggtggcgagaataataacggatagcccgaccaaaccgacttcagctaaatggagtgccagtgccaataccaaccagacaccaataatggcttgtactattaacttcatcttctcttgcttggtccgtttcgcactggcttgctgatcgtattcggtcagaacctgacgcacacgttctggcaactgggcaccataaccaaacagtttaaatttttcgaccagcaagcagaccaataacccgaaaataaagacgggtaaggtgacgggtaacatgcgaataaagaagtcagcaaaattccaacccgcgcttttggcaataatcaaattctgaggctcaccaaccattgtcatgacgccccccagagcggtacccacgccagcatgcatcatcagactgcgtaaaaatgcccggaattgctctaatgtttcatggctgtcctgattatcgattccgctgtcatcagtaatatctttgtcactgtgatttgaagtaacgttatgataaatagtataaaaaccaacggatacgctgataactaccgcgattacggttaaggcatccaaaaatgctgataggaaggctgacgccagacaaaaggccagggaaaggatagtttttgaccgaatattcaacagcaatttcgtaaatacaaacagcagcagctgtttcataaagtagatgccggccaccataaatactaaaagcaagaggacttccaggttattggcgatctcttctgcaacttgatgcgggctggtcatgccgatggcaacggcttgaatagcgagcaaaccccccggttgcagcgggtaacatttcagcgccatggctaaggtaaagataaactcgataaccagcatccagcccgcgacaaaggggctgacaaagaagaagactagagggttaatgatcaagaaccccataattgctagtttgtaccaatccggagagttaccaagaaaattcttgagtacagcttgtctgttggtaatgtccattgtgaatgatttttcccttaataaattattatgatgcgattacgacgaaaggttacattttagtttacgtaatccagttaaaagcaatacgtattctctggctagcattacatttgcgcaatttttgcgactttatgactgctttcaccatttgttcggctctggcgctatattggattacactcgtctggtatgatgagcggactaaattgctgatatttatcgctacggaacgtcaaaaacatggttataaaggcgcaaagtcctgccggtttcgcggaagagtatattattgaaagtatttggaataatcgctttcctccaggatctattttgcccgcggagcgtgaactttctgagctgattggtgtgactcgcacaacattgcgcgaagtactacaacggctagcccgcgatggctggctcactattcagcacggtaagccaacgaaagtaaacaatttttgggagacatctggtctaaatattttggaaacactggcgcggcttgaccatgacagcgttccacaattgatagataacttactggctgttcgaaccaatattgccactatttttgtgcggacagctatccgtcatcatccagaaaaagcgcaagaaattttggcgcgagcgaaaacagtggatgataacgcagaagcctttactgctcttgattatggtattttccgtggtttggcatttgcctcaggcaatccgatttatggtttgattcttaatggtttgaaagggctttacacccgagtagggcgttattacttttctaatccagaagcgcgcaagctggcactgactttttacaataaactgtcgacgttatgtgatacagaatcttatgatcaggtactagagtgcctgcgcacatacggcaaagagagcggggctatctggcatagcatgcagggcaccatgccaagtgatttggccgaagcgcgtcgttaggcgataaagcaaaaaagcgaaggggcgtttaatgcccctgaggttattgacaacgctatttttagccccgtgagtgaaggggtgaccgcacctcggggcactccggtggcttacgccactacgaccccaacggcacgtttccccttcatttgactttgtcagcagtttgaggggcgtttaatgccccttttttaccgatgtcatatgcggtaatgacttaaatcttactggttttctgcggaatgctgtcgagcaaatcgatactgccatcatcattcaattgttccatatgaacatcaaacccccacagccgatgaatatgcttcatcacttgctggcggcttttatctaatggcgctcggtcatgcgggatataacgcagtgtcagagagcggtccccacgtagatcaacattccatacctgaatgtttggctcatggttgctcaagttatactgtgcggacaattgattgcggatagtacgataaccttcttcattatgaatagccgaaatctccaggtagttattcttgtcgtcgtccaacacggtaaacaggcggaaatcgcgcattatttttggcgataagaactggctgatgaaactttcatctttaaaatcacgcatagcaaaatgtagggtatctaaccaatctttcccggcaatatctgggaaccaataatagtcttcctcggtcggggactgacagatccgtttaatatcctgaaacatagcgaagccaagagcataagggttaatgccgttgtaataagggctgttatacggtggctgatacacgacgttggtatggctgtgcagaaactccatcataaagcggtcggtgacccggccttcatcgtataaatggttaagaatggtgtagtgccagaatgttgcccagccttcattcatcacttgagtttgtttttggggataaaaatactggctgactttgcggacaattcgcaatatttcacgttgccatgattccaacaacggtgcatttttctccataaagtagaggatattttcttgcggttcgttggggtagcgctgtgcctgaacaggagcttcttctcgatctttacgtggcaacgttttccacagggaattcacttggctttgtagatattcttcacggcttttttggcgtgcggtctcctcgaccagcgaaattttttgcggacgcttatagcgatcaacgccataattcattaacgcatgacaagaatcgagcaaccgttcaacctcttcaacgccatagcgctcttcacactcattaatatagtggcgggcaaagagtaggtagtccacgatggagctggcgtcagtccacgcgcggaataaatagttattcttaaagaaggagttatgtccgtaacaggcatgggccataaccagtgcttgcatcgtgatggtattctcttccatcaagtaggcgatacaaggattcgagttaataacaatctcgtaggctaatccctgttgaccgtacttatatttttgttcagtttcgataaattttttaccgaaagaccaatgggtatagttaatgggcatgccaatacttgaataggcatccatcatttgttctgaggtgatcacttctatctgatggggataagtatcaagccggtaatgtttcgccacccgatctatttggtccagatacacttgcagtagctcaaatgtccagtcagggccgtcagtcaggcgcttatcttgcgtggtctgtttcgatgttgaagttgtcattagcgcatcctcacgtttttatcgcccaactcaaatactcgtcactttactaatcctagctcaatatcaacaaactgaggcatggcaagaccttatgtcaatatagattatttcttcctggcataatgaataaacttattaaggcttattatggttcattgttctgttaaatagcttggtttatggaatataaatctaataaaaaagactttttgcaatacgccgttcattcgtgctgacgatcgtaataatagcctttttcagtatttatcccggattacggcttggagtagggcgtttgttgctgcctgatcaaactcattgaactgaaaagaaattacagcgtaaattaattgagagacaagtcacaatctataattaatatgttggctagttttttccactgggttaattttctgtaagcagaacattatgctttgtacatgttttaggtgagggtgatatgcgcgttgtcattttaggaagtggtgtggtgggtgtcaccagtgcctggtatttagcgaaagaggggcatgatgtcacggtcattgatcgtcaggatggccccgcccaggaaaccagtgccggtaacgcaggtcaaatctcaccggggtatgccgcaccttgggcggctccaggcgttcctcttaaagcgatcaaatggatgtttcagcgccatgcgcccttggctatccgtttggatgggagcagcctccagttacgttggatgtggcaaatgctgaggaattgcgatacgtctcactatatggtcaacaaaagccgtatggtccgtctggcggagtacagccgtgattgtctgaaagacttacgcgcagcgacaggtattcaatatgaaggtcgccaaggggggacgctgcagcttttccgtaccgaacagcagtttgataacgcggcgaaagatatcgccgtattggatgatgccggtgtcccttattcactgctgacggcagaacaattagccacggtggaacccgctttggcgaaggttgcacataaacttactggcggtttgcgcttacccaatgatgaaacgggcgactgtaaattatttactgagcggttggcaaaaatggccgagcaggctggggtgaaatttatcttcaatcgctcggtcgataaactgttggtagagggggaccaaatagccggtgtactgtgtggtgatgacattatcaaagccgatgcctatgtggtggctttcggcgcttattctaccgcgctactggccgggctggtgtctatcccggtttatccattgaagggttactcgttgaccatcccaattacggatccggcctcggcacctttttcaacggttctggatgaaacttacaagattgctattacgcgctttgatgatcgtatccgggtgggggggatggctgaaattgttggttttaacacgcaactggcacctgcccggcgtgaaacgttggaaatggtcgtccgtgatctgtatccccatggtggtgatatcagccaggcggtattctggtccggtctgcgaccaatgacacccgatggcactccaatcgttggccggacaccgctgaaaaacctctatcttaatacgggtcacggcacattggggtggacgatggcatgcggctcgggtcaattattggctgatataatacaaggtcgtcgcccagccattgtggctgatgatttatcggtagcgcgttaccgcgcaggttttcagccactgaatattgccccgttacacgatattcaccccatccgttaatatcgtgtaacgcgattatttgccgttgttagtgtatttcttccaacttgccgcggacatgtttactggctcggcgcgcttgccacgccagtaaacagccagccagcatcacgatagctagtgacaacttaggttcaatcggcagtgccatcgccaacaggcctaatgcagcgcccccagccatttgaacaaaccccactaacgctgaggcgacacccgcttcattcgcatagggttctagagcataactggtggcaggccccatcataaaggctaaaccggcacaggcgctggcaaccggtaacatataaaccagccagtgatgctgcacatcaacggacagttgtgtcagaccaaatagcaagccaaaacagcctaaggccatcaataaactaccgatcatcaggcaggtagggcggcccactttttgaataatccggttagcaaaaaaactgactgccataatccagaagccattagccccaaatgccagcgaaaattgtaacgggctgaggcctgcatcaaccatcaatacattcggtgccaatgatacataggttaatgccatgcccatggctcctgcattgaccagagcaaataccaaaaagcggccatcacgcaaaatacgcaggtagttttttattggcaggccatttattggttgagtattcgccgggcgggtttcgggtaagaacataatgattaagactaaaaccagtaatccgtataatgccaggaaccagaacggtgcccgccagccaaaggcttcggccagtaaaccacctaatagcggggccaatgcggggacaatattcaacgtgccattaaggaagccaaaagcacgtgcggcttcattgccgctaaggcggtcacggacgccactgaaggccaccacggctgtgcagcataccgagacaccttgtaacaagcgggagctgacgaacatgactggatccacggccagagcggccatcgcggcacccagcatgtaaagaacaataccgataatagcgattggcttacggccatatttatcaaccaatggcccagcaatcagttgcccgatacccagcacgagaataaacagcgcaatagttgattgaatcagagactcactactattcagcccttttgcaatggctggaatggtcggtagatagagatcgatccccaaagggccaagtaaaatcaagcttaatagcaggaaaaggaatttttgcatgaaaaagaaatcgcatccaaattacaaaggcgacaagaataagggctttacccgtaaataggaaacccataagtgctaagcgtgattttgtgacaccgtcacgtaatggtgaatggatttttatggtatgccaattgtgggaagttcacttatcactgacgacaatagtcgctagcaagagttggctctcatcaataaaaaatgctattacctgcccagagggtagacaggtaatagcagacaggtaatggcggatagatgccgttatgcaacatccatattcccaaagcggccaccattaaaatcagcgatagcttcggctatttgtgcctgagtattcatcacaaatgggccataaccgacaataggctcgtcgattggctcaccgcttaacagcagtaacacggtgtcattattggcctcaatactcagatgagtgcccgtgggatccagtagtaccatttccgcttcgcgggcaatggcatcaccattcactaagagggttccgtgtaacacaatcagtgcggtgttccagcctgcgggtagtgaaaattcacaactctttccttgagttaaccgaatatcccagacattcagtggtgaaaatgtctttgctggcccaatgtttccggcatattcacctgcaataacccgcagattccctgcatcgtcaggtaaattaacctgtggaatagcctcacgacgaatcgcctgatagccgggtgcggtcattttatctttagcaggtaaattgacccatagctgtaccatctcaaaagagccgcctttttgcgcaaaagcatctgagtggaactcctcatgcagaatacctgcacctgcagtcatccattgcacatcacccggaccaatgataccgccgttaccagttgaatcgcggtgttcgacttcaccgtgataaacgatggtgaccgtttcaaaaccacgatgtggatgttgcccaaccccacggcgttgcgtcgtcggggtaaaatccatggggccagcatagtccagtagcaagaacggactcagttgtttaccgtgactttgataagaaaacattgaacgtactgggaagccatcgcctacccaatgttgacgaggtgcacggtaaataccttgaacttttttcattatcttctccttacgccatcattaatcaattgcagtacaggggacgcgatcaatcagggttcgcgatagccctgcagccaagttggataaagtatagttttaggataatgtgagcggtagtcggcaaaattaactctcactgttccacaaatagaacaatacttgtcgaattgcttattataaagagagaggcggatatgcacgatctcaatgatctctattactacgcagaagttgtagaacatggcgggttcagcgccgctgcacgggtgttgggcttgcctaagtccaagctaagccgccgattggctctgcttgaggaacgtctgggggtgcggctcattcaacgctcaacccggcgctttgctgtcactgatgttggccgtacctattacgagcattgtaaagcgatgatcgaagaggcaagagcggcgcaggagtctattgatttaacacgtgcggaaccacgcggtgtggtgcgaatcacctgcccggtggcgctgttgcaggcgacggtcagtaccatgctggcggattttatggccagttgtcctctggtgacgattcatctggaagcgactaaccggcaggttgatcccgttgctgaggccattgatattgcgattcgcgtgcggccaccgccattacaaaatagcgatttagtgctgcgggttctgggtaatcgctgccagtgtttggtcgctagccctgagttgatagggcgacagggtgaagtaaatactccagttgatctaaccggttggccaagccttgggttagggcaacctcagcaaacgtttatttggaacttagaagggccggagaaggctcatgcagcggtgtatcatcagccgcggttggtgacagcagatatgaataccttacgcagtgcggcattggccggtgtaggggtagtacaattgccactgatgatggtgacggaacaactggccgaaggcacattagttcgcctattgcctgattggtcagtccgccatgagattattcatgctgtctatccttcaaggcgcgggttgctaccttcggtacgcagcgtattggattatcttgttcagcgcttcagccaattggatgaacggtgagagtttggtgtttataccgctaacgtttgcaccgctagtgcttatgttgatgatacttatgttgattatgcttatgtcgaggatgtttatgctgatggtgtgaatcaggaaaatgcgaatgagagtgtgccatcggtaggtgctgatgacgatgcttatgcgcggtacccgcgtctaccggaaagtcatggcgatgttgatgatgttcgtcatgaatatgttcatgctcatgtatcatttcatcatgggtatgttgatgttcatgctgctccgtaagatgtaacccgatccctatcgccatcaaaatacccgcgatgagcaacggaatggtgacagtgtcacctaaggcgacagccaacactgcgcctaagaacggagcaatagaaaaataggcaccggtgcgggcagtaccgaggtgacgtaatccaatgacaaatagcgccaaactgacaccataagccaaaaatccaaccaacaatgcgccagcgagatttgccaaagggggcaatgttgctccgagggcgaaggccagcgccagattaaccactccggcaacgccccctttgacggcggcaatccaggttgcatcgttcagcgagactttacgggtcagattgttatcaattccccaggcaaagcaggcacctaaaatggccagcgtcggccataatccggcaaattgagcctcttttggccaccagttaagtacttcttctggccagctaagcacaactgcgccagcgatgataatcaccatccccagagcaatacgacggtcaacattctctttgaaggcaaaccaggctaaaagggcggtgaataccccttcagcattgagtaacagtgatgcgccagaggcgggcatacccgtgaggccgaccattagcagcacgggtgcgatgatccccccggagaggatggcaccaataaaccacaataattcattacggggcagactcaccgccgccgggcgagtgatcaaacggtagagtgttaagccaatacccgagccaaggtaaagtaaaccggccaataaccaggggctaacggtattcagtaattgttttgccagaggggtaccggcaccaaacagtattgcagcagacaatgccgccaatacacccggatgccgtagtccatcataccatttcatcaattcagctcgtgatccacaaatagcgagaagtgataattttagcccatagaaaaagccggaaaatgctttctgaacaagaaaaaattaaccggctgatattgctgctaattatctacggtctgtttgtggaacaactcacggaagacgggataaatatcttcgggttcacgaatatgttgtatggcaaagttgtcgaatttctcttccagatcttcatactcgcgccataacgtttgatgagcgcggcgggttatctcgatataactgtagtaacgcaccaccggtagaatctttttggccagtaattcatggcacaacggtgagtcatctgcccagttatcaccatcagaagcctgagcggcataaatgttccactgcgccgggttataacgctcttgaaccacttcatccatcaatttcagtgcactggagacgatggttccgccggtttcttgcgagtagaaaaactcctgttcatccacttctttggcttgcgtatggtggcggatatacaccacatcgacgtttttataggtccggctcaggaagagatagagcagaatataaaaccgcttagccatatctttcgtggcttggtccatggatcccgagacatccatcaagcagaacatgacggcttgactggagggctcagggcgacgctcgtaatttttatagcgtaaatcaaaggtatcaataaacggaacccgagcaattttttgctttaactcggtaatcgccttgcgtaagcgctcttcttctaacaattgcgctggctcagaattctccagcacagtaagcgccgcctccagttcacgcaactcgcgccgtttgctggcggtcatcgcggtccggcgagccagtgaattctgcagtgaacgtaccacactgatattggctggcacgccattagaggtatatcccgctcggtgtgtcttaaattctgccagctgtttgtactggtttcttttcagattgggcagggcgagatcttcaaacagtaagtccaggtattcatctttagagatctgaaagacaaactcatcctcaccttcaccatctttaccggcattaccttgaccgctaccgccacctccgccgccttgagggcggtctacccggtcattggtgataaagtggtcattgccagggtgcactcgatggcgcaacccaccattgccttgatgaaacattggctcattgatgtcgtcgataggtattgaaactgactcgccactttctatatcggttaccgaccgtttgttgatggcatcggcaatcgattgtttaatttgcgacttatagcggcgtaaaaagcgctggcgattcaccatgcttttattcttgccgttaagtcgtctgtcaatgaaatagcccatatatcccccaaacgactttgccaagcttgcatccaccggcctcacactgtccctttgtccttggcgttacagcatggttagcggcaacgccaaggacgtagtgcatagttttgccttcctgtgcctgaactctattttcgatagaaaaattatgaagactttcttacccgcagataccattcacatagcaaacgaacttgcttacgggtataacctttctccatcatcctatcgacaaaatcatcatgctttttctgttcatccgttgacgttttggcattaaaggagataaccggcagtaactcttcggtattggagaacattttcttctcgatcaccgtgcgcaacttttcataactggtccagtttggattacggccattgttatttgctctggcgcgtaacacaaagttgacaatttcattacgaaaatcttttggattactgatacctgcgggtttttcaattttctccaattctgcattcagtgattcacggtcaaacagctgaccggtatcaggatctcggtactcttgatcctgaatccaaaaatcagcatagataacataacggtcaaatatgttctggccgtattcagagtaagattccagataggcggtttggatctctttcccgataaattcggcatatttggggatcagataacctttcaggtgctcaaggtatttctctgcaatatcttgttggaactgttcacgctcaatttgttgttctaacacataaaacagatgaactgggttggctgccacttcagcatggtcaaagttaaatacccgcgacagaattttaaaggcgaaacgggtggataggccgctcatcccttcatcaacccccgcgtaatcccgatactcctgataagatttggcttttggatcggtatctttcaaactttcaccgtcatacacccgcattttggagtaaatgctggaattcgctggctctttcattcgcgaaagaatcgagaaccgtgccagcgtttccaacgtccccggagcacaaggtgcatgggtcagttcactgttctggagcaacttgtcataaattttgatctcttccgagacccgtaggcagtaaggcactttgacgatataaacacggtcaaggaaggcctcattatttttattattacggaatgtcacccattcagattcgtttgagtgcgcgagaataattccactaaatggaagggcggatattccctccgttccgttatagtttccttcctgcgttgcggtcaataatggatgcagcactttaataggtgctttaaacatctcaacgaattccattatcccttggtttgcgcggcacaatgcaccggaataaccataggcgtcaggatcgttctgggcgtgatgctccaacttacggatatccacttttcccaccaatgcggaaatatcctgattattctcatcaccgggttcagtttttgctatcgcaatttgttcaaggatagaaggccagactttgataaccttgaatttagtgatgtcaccgccaaactcatgtagccgttttgccgcccatggcgacatgatagtaccgagatagcggtttggaatgttgtactctttggccaaaattgccgcatcttcctgcgggttaaataggcacagaggatggtcattcacggggctacgttcgccattagcacttaatatatagataggcacacgttgcatcagcgcttttaagcgctccgccagtgatgatttacccccgccgaccgggccgagcaaataaaggatttgtttcttctcttccagtccttgagcggcatgtttgagataagaaacaatctgttctatggcttcctccatgccatagaactcttcaaacgcaggataacgcgcgataactcgattagaaaatagccgagacatgcgggattctagtgcggtatcgaccatgactggctcaccaatagccatcagcagacgttcagccgcattggcatacgcactacgatcttgctgacagatagcgaggaattcctgcagagtgaactcttcgtccttggccgcttcatagcgctggcgataatgatcaaatatgttcatagcgatgcccgtcctgtttgaatggttgggaacataaaagagtagcagtgctttattgggttaaaattttgaaactactaccttattgttatggtcgcgtctcctctaaaggtcaagttagccctgaccatagatttgccacccttagaacaataaataaccattatttagtaattaaatctattttttatttcattgtcagtatgttgtatatgattaattggacttatctgtttgaatatctcgttattttattgtaattaaatagacgtaaatttgggattgccagtgagtccatgattggtagtaagtgaagcagagggcacttacatcaatttttcatatgtaaagatttcgctactggcaaccaattgatttacactaagttagctgattattttgttactaagggaatttacttcgtgaaaaaagatcgtaaagaaatgaaccaaataaaaacgctggcggctttaacggttgcattggctgtttgcatgccaaccgccaatgcgggaaattggtctctgggggcttctgcattagtcagcccggacccttaccgtggcaagaatgatcgtgtctatcccgtacctgttgtctcttatgagagcgataatttttacttccgaacgctggcagcaggttattacctgtggaacgatagcagtaatcgtttatccatcgatgctttctactcaccactgcacttcaaacccggtgacagtgacgatcagcagatgaagcaactcaatagacgtcgtagcaccatgatggcagggatgtcttattctcacattgaggattgggggactctgcgtgcgatgtttgctggtgatatattggataacagtgatggttttgtcggtgacttagcgtatttgtaccgctttagcattgatagctggacgttaacgccgggtgtcggtgtgagttggagcagcaaagatcagaatagctattattatggtgtgagccgtggtgagtctgcgcgcagtggtttggctgaatataacccaagcgatagctggtcaccgtatttggagctgtctgctaattacaacatcaatccaaattggaatgctttctttactggccgttatatccgtctggctaatgaagttaaaaacagcccaatggtggatcaatcatacactggcgtgttgtggacaggcgttacctatacattccgctaatcagcgttgagttgctatgagcaagaccatggggccaaaggccccatttttatattgaccggactgccgggattaggtgtttttacggctacggatggtcatcgccaaacgtgctggtgcatcaggcgcagccaccaatggcttgttgactcgtgcggtttctacgcaaaccatcgttttatagccatcatttggcatatctaccatgctgcaggacaattcagcgccggggttccaagcaaccacatcactttggtgatggtgatggacctcaatagttcgtttcagcgcggcatcttttatcagactataggcttcaggttgggtatagacacggtcagtttggccgttaaagactaaatcgccttgttgagtgacatcggcaactttcagcactttatctaaatatttctcacccagcccgctgactttaatttggcttatatcgccaatctggaagtaggtatgtaatgccgcagcagcctgataatcaccgtgtgattccagttcaacttcacattcatctcccaacttgaaacgggcgatcagggtgaaggcatgtggccagtattggcgggtcatgtcgttgtcttcaagggtgaaagtcagaatgacgccgttttcattttcatcatgagcactgagcgtccatggcaagatgcgggcaaaaccatgggcaggttgtgcggttgggccaaaccaaggccaacaaattggaacccctccacgaatcgcaataccttctttaaaaggcgtgttattgctcagccagataatgggttgctcaccactgggttgataggccagtaagtgggccccctgcaaacttattgccgcacgcaccttaggatgagaaacaaccactaccggcaattcatccagttgacgctggctgatataaggagaaatttgttcaacaacagggagagtaaatactttctcgttcattcgtttggccttatgggaaaaggaactggattcagttgagcttcagtctttcgataatatcacaggcattgaatcttgcagcaagcgtgcgatgcaggtgtggcgaatcattgatatggcgcaagattatccttcatgctgagatggctgagatgttagcagtgcgtacttagccgaatcagttactcatcagaatgacttactggagtagaacgtagagggagaggatggggttgggaatagggcggcaaatcttattcggcgctataaacaagaaaagccactcgcgtgagtggctttaggtagaaatctacatcaatcgattacttggagatgtgagagatcagatccagaactttgtttgagtaaccagtttcgttatcgtaccaagaaaccagtttcacaaagttgtcattcagcgcgatacccgctttagcatcaaatactgaagtcagtttttcgccgttgaaatcggtagaaacaacgtcatcttcggtatagcccagaacgcctttcagctcgccttctgaagccgctttgatcgcagcacagatttctttataagaagctggtttctccagacgtgcggtcaggtcaacaacagaaacgttaggagtagggacgcggaacgccatacccgtcagtttaccgttcagttctggaataactttacctactgctttagccgcaccggtagaagaagggatgatgttctgggatgcgccgcggccgccgcgccagtctttatgagacgggccatcaacagttttttgagttgcggtagtcgcatgtacagtggtcatcagcgcttcaacgataccaaatttgtcgttgattactttagccagtggagccaggcagttagtggtacaagaagcgttagaaacgatttcttggcctgcgtaagctttgtggttaacgcccataacgaacataggggtgtcatctttagatggaccagtcagaacaactttcttagcgccagcagcgatgtgcttacgtgcagtttcgtcagtcaggaacaggccagttgcttcagcaacaacatcaacgttaacttcgttccacttcaggttagccggatctctctctgcggtaacacggatggttttaccgttaacaaccagatggccgtcttttacttctacagtaccgtcgaaacgaccgtgggtagagtcgtatttcagcatgtatgccatgtaatcagcgtccaacagatcgttgattgcaacgatttcgatgtcagaacgttcctgagcagcacggaaaacaatgcgaccgatacggccaaaaccgttgatacctactttgatagtcatatattccaccagctatttgttagtgaataaaaggttggttgtaaaattacaaaaaccttgccgagcgtcaagcggaatcgtgtcaattattgctacaaatcaaaccaagggcggtagttcgaacattaattacacgtttccagatacgataagcctcgttactatgttggggcacaatattcagtttaaagtgataatcgataatatttgcgatttttatcacatttacgccgttgccacctcgatggcatacagtttaggacaattttaactgctttgttgttaattttttgttattattagacgttgttttcgttgactttattccctgccagagaaccgcaaaaatggccaaagaactgaaccctacagaaaatattgagaaactgtccgatattcagcggtatgtcacccaagaacgtggaacggaagcccccttcacgggcaaattgttgcacaataagcgtgatggggtgtaccaatgtctgtgttgtcaccagccgctctttatctctgaatcaaagtttgattctggctgtggttggccaagcttctatcaacccattgacgctgattcaatacgctatattgatgattattctcataatatgcatcgtatcgaaattcgttgtggtaattgtgatgcccatttggggcatgtattccccgacggaccgcagcctacgggtgaacgttattgcataaattcggcgtcactgaatttcgttgatgaccaaaatggtgagcaaactgcaggctgaagagaaacatcgcaattacatctatgaagaatcgattcagcttattattcgtttatccgaggatgctctgatggagcttgaagacctgatttcagtaatgacccccgaaatataccagcgtttagtgcaagccgttgaactggggaagtggccagatggtgtggcgctgacatctgagcagaaggaaaatagtctgcaaatggttatgctgtggcaggcccgccataaccgtgatgctcaacatatgagtattggcacagatggtcagatagtgatgaaaaccaaacaagagctgaaacagcagttcagtcagtcaacgttggttaagttgaaaccagaataatcgctaaggtacgcaaaattgagttgcgtatcctcacataatcaatatcctccggcattgctgcctggcagagggttttctgaatacaaaaaatgggcgccgaggcaggcgcccatttttgcgcagaaagcgatcagtcggctgaagcgacttcagccaggcattgttcaagagccagtaagttggcgcctgcatcgctcatcgcatcgaaagccagttggctgtcttgtggttgcaagtttaccccacgacacccatcactgataaccgtggtttgataacccaaagcgagtgcatccagtacgctatatttcacacagtaatctgtggccagccccataacatacaggtggtcaatgctatgctgttgtaaccagctatctaatgctgttttagctcgccggccattgtcgaagaaagtgctgtaactgtcgatatcagggttttgccctttgcgaaaaatggctgtaatagcgccttgtttcagctgtgggtgcaatgctgcccctggttgttcctgaacacaatgtaccggccaccatacttgtactaacccttctagttccccaactgtgcccggctccgccttggcgttcaccgcaaagctacggtgctcaattgggtgccaatcttggctggcaatcaccggtatgttttttgcgagacaggcttcaatcatgcggttagccacgctaatgacctcatcaccttcactaacagccaacgctccaccaggacaaaagtcgttttgtaaatcgattaagagcaaggctgctttcattaaaatcccaaaagttattgagtatcggttaattcaccacgtaaattttgctgcatcagttggcgaatctcgttaggagataaagattggctcaacaaataatgcagttttgtcaacgccgcttcgactgtcatgtcaaatccactgatcacccctgcttgggctaaggcattacccgttgcatagccccccatattgacactgccggaaatacactgcgtcaaattcacgacgacaataccacggtcactggcgttttttagttcatccagcagttctgctttctgcggtgcgttgcctaccccataggagcgtaaaattaaggctttcacgggttgcagtagaaagttccgcactacggcaccggatatccctgggtagatagtgaccaccccaatcggctgtggcgtaatgcgatggacaatcagtggaccattactggcgggtgacacgaccgatgattggcggcgaatatggatccctgcctccagtaatacggaaagattaggcgaggcgaaagcatcaaagccatcggcatgggccttggtggtgcggttgccacggaacagttggttattgaagaataagctgacttcattcaccggatggttggctgccagatagagggcattcaacaaattggtttgcccatcagagcgtagctcggccaatggaatttgtgagccggtaataatcacaggtttggccagattttccaacatgaaggacagggcggaagcagtaaatgccatggtatcggtaccatgtaaaatgacgaagccatcatataggtcataattttgctgaatatcattggcaatatgttgccaatcctccggggtcatatccgaagaatcaattaatggtgcatattcatggatagtaaaatcaggcatctccggacgatggaactcaggcattaaagccagttggcgttgcaaatgaccggatacgggaatgtacccattatctgaacgttgcataccaatggtgccacccgtgtaagcgacgtaaatagatttcttctgcatgggggatacctgaaaagtaatgctgggattggatgattgaattataaggcgctcagcgaggaaaaacagcccgatgggtatcgggctgaatatttatctgtattttaggacgattattagcggacatcaccacaggttaggcacagagcataacgattctgcggatcattcagggtattgaataaaccaggttgatctttaaccgcaagcgccatagcagataaaggcgcgggtaaccacgtctgaatagccgctggcaacatagcgtgcaccgacgcgctcatttgacccaaaataaggtcgcttaagcttggctcatcaacaaaccaattcaattgccaagtcttcagtttggccagttctgccgcctttttcacggcatcatcaaaatcgccgagttgatcgactaaaccgttacttttagcatcgaggccaatccacacatggccttgtgcaatttgatccacttgctcaggggtcttgtggcgagaagttgcaaccaaatcaataaaggttttatacccattttcgatattgatttgcatcatctgagagaactcaggcggcaatgctttggtcagtgacacgtcagctaatggtgatgtcgcgacaccgtctgtatggacaccaatacttgccagtgaattttggaaggtgttaatcacaccgaaaataccaatggagccggtcagagtgcttgggctggcaacgatatagttcgctggtgttgagatccaatatccaccagaagccgccattccacccattgataccaccaatggcttatgggcagcacgtaatgcagccaattcggcgcggatcagttcagaagcgctcacactgccgccagggctgtttacacgcaagataaccgctttaatctttggatctaaacgggcctggcgaatttgtgctgccagcgtatctccccccacgttcccaggggtttgcgggccgtcaataattgctccgttagcgaagagaaccgctatctgttccccttgctgtggtgcgggtgttggctgatagtcataaatactaatgtagttgaagtcattagtctttttattccagccaaaggcttcaaccagtgcactttctacttctggtcgggctgctaattggtctaccagtttgctatccagtgcgtatttagcttgtgagccacccgctacctgtaagccactgatcacccctgcggccccagggaacagttgttctggggtgagtcggcggttagcggagaccgtggtgaggtagttttgccacaagccacccacccagcggctatcggcttcacgggcagcggcggacatatcattacggatcatcggttcaactgctgatttataagtccctacgcggaagatattggtcgtgactttaagattttccagcagtgacttgtaataaaggttattgctggcaaaaccgtgtaggtcaacagccccttgtggcgagagataaatcttattagcaaaactggctaaatagtattgggtttgattgtagctgtcgccgacggcataaattttcttgccggtgtcgcgaaattcccgtagagccttaccaatatattgcagcgaggattgatctgcccccgttaagtcactcagagacagaaccaggccgttaatattgtcatcgtcttttgccagtcgaatggtttctacaatatcaaacagggagttttcctgtaggcggttactggatgcccctaatagctcacgtccccattggcgtagtttattattgatagcaggttgatctacgatcacaccgcttaaatttaccagcagggcacctttaactggctccacaggcttactttgaaattgaaaataaataccgacaccgatcaaaataagcagtgccaaaaaaagattaaggataagctctctggtgaaattcagtagacgccaggtccacttgaaaaaaccagcaataattcgccacaaagtgcgcatatgatctccaacaaaaccgggaaagtagggttatcctaatgacctgatgaaaaaaagtcagctttaaatcatcgataagcctagctgataggtcaacgctggcaacaaaacgtaaacttatgctaccgtgctgaaaatgaaaatcgttatcaggagataataatggatgcgttggaactcttacttaaccgccgctcggcgtcccgtttaaccgctccggccccagccggtgaggtcttggaccatattattcacgcaggtatgcgagctccggaccatggtgccttgcagccatggcgctttgttctgattgaaaacgaagggttagtgcgttttagtcaattgttacaaaaagcggttcagcaagatggtgctgatgagacggtcttagagaaagcgaagcaggcaccttttcgtgctccgctgattattacggtgatcgcccatgtaactgagaatgccaaagtgcctaattgggaacaggttgtttctgccggctgtgcggtgcaagcaatgcaaatggctgctttggcacaggggtttaatggtatttggcgcaccggttcttggacccaccacccagttgttcgtcaggggtttgcgtgtcgtgaacaagacgaaatagtcggctttttgtatctcgggacaccgcaattaaaatctgcaactaaaatcatgcctccagaccacagcgcttttgtccgctatttctaagtcttgcgcgttttttcttcactcatgttatgcagcttatgttctttacggggaataagctgcgttttagcctgctttgtgaccaacctatctgcccgacaggggcaccgcacttaccaagccacgtcttaagcgctaccataggcaatctggggattattttattgaatcaatcgacgacttactaaactgcttattaccgaatgacctaacgggagagttctatggcatcgccagcgatacgtcttactcaatacagccacggagcgggctgtggttgcaaaatttcaccaaaagttttggataaaattttgcatactgagcaacaaaagttttttgatccccggttgctggtgggcaatgaaacgcgtgatgatgcagcggtttatgatattggtaacggtgttggcattatcagcacgactgatttttttatgccgatcgttgatgatccttttgattttgggcgtattgccgccacaaacgcgatcagcgatgtatatgctatgggcggtaaacccataatggctattgctattttggggtggcccattgacaaactggcacccgaaatcgcacagcaagtgatcgagggtgggcgatatgtttgccagcaagcggggatttctttggcaggcgggcactctattgatgcccctgaacccatttttggtttggctgttaccggaattgtcagcactgaacaggttaagaaaaacagtgctgcaaagccaggatgcaaactgtttttgaccaagccattgggcattggcatcttaacgacagccgaaaagaaaagtaaattacggccagaacatcggggattggcaacggaaaccatgtgtcagttgaataagcccggcgctgattttgcgcatattcccggtgttaccgccatgaccgatgtcacggggtttggtctgttggggcatttgagtgaaatttgtcagggttctggtgtccaggccattctgcattactctgcgatcccacgtttgcctgccgttgaagactatattgctgaaggttgtgttccaggggggactgggcgtaatttcgacagttatggtcacctgatcggtaatatgtctgatttacaaagacaattactttgtgatcctcaaacctctggcgggttactgttggcggtcttacctgatgctgaagccgatgtacaggccattgccgctcagcacggaatgaccctcagcccaattggtgaattaacctcggcggatagtcgccgggcgctgattgagattgtagtgtgatggattgtagtgtgatggattgtagcgtgatgttttctttgacgtatttatgcggtgaatgatgcgactgtttattgccgaaaaacccagtttagcgcgagcgattgcagatattttgccaaaaccgcatcgtcgaggtggtggattcatcgcctgtggtaatgatcaaatggtgacctggtgtgttggtcatttactcgaacaagcccagccggatgcttatgacagccgttatgcacgttggtcattagcggacttaccgatcattcctgaaaaatggcagctacaacctcgtccttccgtcagcaaacaactcaatgtgattaagcaactgttacagcaagccgatgaagtggtccatgctggcgacccggatagagaagggcaactgttagttgatgaggtgctggattatttgggattggccgcagagaaacggcaaaatgttcgtcgttgcttgattaacgatttaaacccacaggcggttgagcgtgcagtggagcgcttgcgttataaccgcgagtttatcccgctgtgtgtttctgcgttggctcgagccagagccgattggctctatggcatcaatatgactcgcgcctataccattcttgggcgcaatgcgggctatgacggtgttttatccgtcgggcgggtacaaacgcccgtattggggctggttgttcgccgtgatgaagagattgaaagcttcattcccaaagatttttttgaagttaaagcccacatagtgacgcctgcagacgaacgttttattgctctctggcagccgagtgactcctgcgaatcttatcaggacgaagaagggcgcttgttgcatcggccgcttgcagaacatgttgtcaatcgcataaccggccagcccgcgctggtgacatcctataatgataaacgggaatcggaaacggcaccgttgccattctccttgtctacattacaaatcgaagctgcaaaacgtttcggcctcagtgctcagcaagtattggatatttgccaacggttgtatgaaacgcacaaattgattacgtatccgcgctcggattgccgatatctacctgaagagcattttgccgggcgtcattcggtgcttaatgccattagtcttcatcagtcagaccttttgccgcttgaggtcatggatagtgatcggcgcaaccgctgctgggatgataaaaaagtcgatgcgcaccacgctattatcccaaccgcacgtgccagcaaagtgaatttgacgacggatgaaggcaaagtataccggttggtggcacagcaatatctgatgcaattctgtccagatgcacagttccgtaagtgtgtgattgaattggatatcgctggcgggaaatttattgccaaggcacgctttttggccgaggcgggatggcggaccttactgggcagtaaagagcgtgatgaagagaacgaaggtgcgccattgccggtggtagccaaaggggctgaattattatgtgaacgcggtgaggttgttgaacgacaaactcagccaccccggcctttcaccgacgccagtttattatcggcgatgacaggaattgcgcgtttcgtacaggataaagaactgaaaaaagttttgcgagccaccgatggcttgggtacggaagccactcgagcaggtattatcgaactgctcttcaagcgcacttttctctttaagaaagggcgttatatacatgccagccctgcgggacgcgcgttgattcatgcattaccggatattgcggcacggccagatatgacagcacattgggaatcaacgttgacacaaatcagtgaaaaaaactgccgctatcaagattttatgcaaccactggtgatgacattgcaggatttaattagtcaggcgaaacaaaatcgttctccacaggttttccgtgggttacccgccggcccttcaggggcacccaagaaacgtaaaaaaatatcgtctaaggccaaggagagtaaatcatgaaaacacggttgctattaagttgcattggctttgccacacttatttctggtgcggcattagcgaatcgtagcaatgttgatgtgattgttcccttgccaccggaggtatggaataactcatcaaaccgtaacacgaacaacaacccgtgcacgcgttgctgtgtttatcaaaatcagaattattcagaaggcgcggtattacggattgaaggtgagattttacaatgtgtgcgtgatgccggtgttattggcaccaatccactgatttggaaaagactaaccagatagttctctgtaggtttattgtctctgtgcgataaacgcgtctagcagcggaatatctgcgggcgccagagagtagcggtaagcctccagcggcgtcagccagataaacgccgcatggcaatgccttactggctctccgctaaaatggttaacataccaggcatgtaagcggatacggttattggctgctacccattggttggttgcgatatacccagcgacagtggcctcgatacctaactcttcggcaagctcacggatcagcgcctgaggctgggtttctccagcctcaactttgcctccaggaaattcccacagccctgcttgatcgctttgcccatcccgctgggccagtaatatcttcccatcccgttctataatggcggcgacgacatcaatcatttcgtgtttacctgattatggataaatttacctaatgacggataaatgtgcttaatacgcttgagaggtggccctgcatttaaacagggcgcagacattaaagtgagaattcggaccaaaccggcgcgtggtctgatggtttttccatcccacggattgcataatcaatacctgtagcaatacaacgagccgccagtggttgactggccagcaataaatcgatgcgaaggcctctgttttcatcaaaaccacgggaacggtaatcaaaccatgaaaaatggtcattacaatcaggattagccgcgcggaaagtatcaaccaacccccagttttgcagacgttccagccactctcgttcttctggtaagaacgagcatttgcctgtgcgcagccagcgtttacggttatcttcaccaataccgatatctaaatcggttggactgatattcaagtcccccatgataagtacctgggcctcaggggagagttgctcctcaagatagcgttgcaggtcagcataaaagcgcgctttagcggggaactttattggatggtcacgactttctccctgaggaaaataaccattgattaccgttaaggtgccttgcggggtggctaagtcggccatgataatacggcgctgtgcatcttcttcatcgcttgggaaacctcggcgcacagccagtggctgttctttcgtcaatagtgcaacaccgtaatgacctttttgcccatggtaaaaaacgtggtaaccatgctggctgacgtcttcaagaggaaacatatcatcatgtaccttagtttcttgtaggccgatcacatccggttgatgctgctcaattattgcggctaattgatgaggacgagcacgtaggccattgatattaaaagaaacgaacttcatggtcagcaccgtttttggctaaaaaatgtgagtggatattagcagaataagaagaagaatgtaatgttctggctgagtataaaataatctgatgtatttcctatttattgaactgattatataaatgcttatttattgatctataatcaagagaaaatattaataatttcttaaaaagaatcatttaattacttggtgattttttaagatcattaaactattattttaatgactaattttaataaaggtgatttgtctaaggtgattatttaattacccaaagaaattaaactatttgctacgatatttatgagtaaatttagggcgttattaatttataattttaaaatttataataaaattaatcacttttctgacagttttaaacttgaagatattgatatagatgcgactagtttcccttattttaaaacgtaaatcatagatttttattacgtctcatacctttatatacctgaatccgttaattgattttgtaatagggaggttaaaaattagttattaaaaatcatggatctacagtgttatgtctgttagaaatgtttgtgatactacagtgggaatacataacaaacactcaacattgatctagaaacatgagaatttacgttgttagaatctatacagtagtcatttttataatttataactcagccatgataagtttaatttagcgtatttagataataaatgaattaaacacatctataacaagcgactaaagcatagacgtctttatgacttgtggttttttctgatgaacttttgacacaaaggattggtgaattatgtttctatctcgaaagttagaagcctttatggcagtagttgagaatggttcgctaagtaaagccgcaagagtgatgaatagaacaacacctcctgttgcaaaatcgataaaagactttgaaagcataatagggaaaaaactctttaaaagagagaaatttggcatgagcctcacacgtgatggtgaggttctatacaatgatctaaaagatttgtatcaacaagaaaaagaaataactaaaaagcatctcacgggtcatgtgtcaaatgttattaatatttattacgactggggtaaaagtgagaatttaactcaactttataaaatcgcagaaaaaaacaatattcaagcaaatataattaagttttattatgaaaatattgatgaaattggagattatgatgggaattcacttatattatcatctgagaaaatagccagtgaaagatttatgcttttgaacgaagtacaagatattggttttggtatatatgggagaaaggatataattaatgaaagtgaagatattataaatattcttcacagtaatgtttggttatgtaatccgacattatacaaaagtaaatttgttaagtcacttgaagaatctgttaaaaaacaatatgataaggttagtgttaggcaggttgataatttggcctgttgtttgaattttatctattcaggacgttacatttgtattaccgattcaataatggatgattttaatggtgattcaaagttggattttgtaaatttaacgaattttaaagatgaaaataaattatatttttacaaatcaagatcacactctagcgtattaaatcgtcttattgattatatacatacattggagtaatcgttaatttaagttagagaaaaaatgaagcagtggtgaggaaaggactcgtcactgcattctacgctcggcgcgaaccttgtcgaaggttcttaccttccccagatatgagaactattttattgcttagtgtatttgggagagggagatattattagaaatggtggtgggagactgtaaacaatattgtgtaattgcctgtttttgatatcttcactccaacaacggagacaggcaaattatggacgaaaagaaacttaaagcacttgcggctgaactggctaaaggtcttaaaaccgaagccgaccttaatgcattttctcgtatgctgacaaagcttaccgtcgaaacagcgttaaatgcagagcttaccgaacacctcgggcacgagaaaaatacccctaaatcaggctcgaatacccgcaacggctattcgtccaaaacactgctatgcgacgacggcgaaatcgagctgaatacgccacgcgaccgcgaaaacacctttgaaccgcagctgataaagaaaaatcagacgcgtatcacacagatggacagccagattttgtccctgtacgccaaaggcatgaccacccgcgaaatcgtcgccaccttcaaagagatgtatgacgccgatgtgtctcccacgctgatatctaaagtcaccgatgccgtaaaagagcaggttgctgaatggcaaaaccgccaactggatgctctgtatcccattgtttatatggactgcattgtcgtaaaagtccgccagaacggtagcgtgataaacaaagcagtgttcctagcgctgggcatcaacactgaaggtcagaaagagctgctgggcatgtggctggcagaaaatgaaggtgcgaagttctggctaagtgtgctgacagagctgaaaaatcgcggtcttcaggacattctgattgcctgcgtggatggcctgaaggggttcccggatgcgataaacagtgtttatccgcagactcacatccagctgtgcatcatccatatggtacgcaacagcctgaaatatgtgtcatggaaggactataaagccgtcaccagcggtttgaaaatggtgtatcaggctccgacagaagaggcggcgctgatggcgctggataagtttgcggaggcctgggacgacaaatacccgcaaattagcaaaagttggcgtacgcactgggaaaatctcaatacattcttcggctatccgcccgatatccgcaaggctatctacaccacgaatgccatcgaatcggtgaacagcgtgatccgtgcagccattaaaaagcgcaaagtgttcccgacagacgactcagtgcggaaggttgtttatttggcgatcaaggatgcatcaaaaaaatggagtatgccgatccagaactggcggttagcgatgagccgttttattatcgagttcggtgaccgcctgagcgatcacctttaatacggtggcagttacacagaattatggacaggctcggtggtgggggaaggattattcgtcactgcgttcctcacccttcgggccgccgctttgcgtcgttgtctcgctacgctcggcgcgaaccttgtcgaaggttcttaccttccccagatatgagaactattttattgcttagtgtatttgggagagagagatattattagaaatggtggtgggggaaggattattcgtcactgcgttcctcacccttcgggccgccgctttgcgtcgttgtctcgctacgctcggcgcgaaccttgtcgaaggttcttaccttccccagatatgagaactattttattgcttagtgtatttgggagagagagatattattagaaatggtggtgggggaaggattcgaaccttcgaagtcgatgacggcagatttacagtctgctccctttggccgctcgggaaccccaccactgagaacgtggtatttattattagtagcctttaaaaattattaacctttaaactcaaagttaatggtggtgggggaaggattcgaaccttcgaagtcgatgacggcagatttacagtctgctccctttggccgctcgggaaccccaccactggccttgctgcttatcaatactgtcttggtaagcggggcgcatcatatcaaatgaagcgcccctgtaaagacttgaaatgaaaaaaataattcgttcggtgcttttttgtccgtgaagatggatatctagacaaaaaacatcactttataggataacagtgcggttaccgtaaacaaaaacacgttgagcgagaacacggtatagcgcactactgagaacattcttttctacatcacgaccagcacgcatcatatcttcagcagtataagaatgatccacattgatcacgtcctgcatgatgattgggccttcatccaagctatcatttacgtaatgagcagtagcgccaataatcttcactccgcgttcatacgcttggtggtatggccgagcaccgataaatgcaggcaaaaatgaatgatgaatattaataatttgataagggaaacgttgcacaaaggccggtgttagcacccgcatatatttagccagaacaacataatctggttgatattgttcaattttctcaatcaactgttgatcatgctgctcacgggtgaggccttcatggctgaccagatggaatgggatatcaaaacgctcgactaaattttgcaatgcatcatggttaccaatgactgccgcaatttctacatctaagccaccataagcactcttcattaataagtcgccaaggcaatgtgcttctttcgttaccataatgatgatgcggcggcgcccagcaacgtgtaactcgcgattagtgccttcaggtaatgcatcgtcaagatctgccagtaatgtcgtatcgttaaaaatcccctcaagctcggtgcgcataaagaagcgaccagtcaggtgatcaacaaattcattattttgtacgatattcaattggtgcttgtagcagatattagtgatctttgcgatcaaacctttagcgtcagggcaaatagtgcgcaatactttcttttgtacattctggtgtggcataaggtggtaaatcctgtcttaacattatttcatgttgtgtaagtgtctgatattttaggagtaacaataaagaaatagtttaattaacggccacagcatttcttgtgttttttccccgaaccgcaaagacatgtatcgtttctacccaaagaggggcggataccgtcaatatagtaccagtgttcttttatacgtaggaagcgagaacgttcgtgcattgccgttatctgtgcattatctgcatcggtgaaacgggaaataaactccacaaaagcttcatcaggatggcgaccgggagtctcagcaataactgttagcccatgccacaccgtcttggtaaagccttgaatgatactttctcgccactcctgtgcatgacagtctggatgccaggtagcaatcagataatccacatttttttctacataagcacaatagcgcgagcgcatcaatattgccggttttgctgcaacctgagtgccgaggatgtaggggccgcagcattcgtggtaattaaggatgctgccacaaggacacagttctgacaaaatttctccagaataatcagcaaggccactcgctcttatcgtatcactacagagtagggctatataggatggtggtactcaatgtacgcctatcttacctaatcactgattgaggttcaaagttgttcgtcttggtaagaatatttcggcatgaaagttttgtgatggatatcacaaaaaaacttgaccgtcgttccattatggcgtaacttagtaactgtgatgtgcgtcacataaaataatgatatttacaggagcaacccatgaaattcatcaataaaattatcgcaatgtttgaaaaaatgaacgtctcattcggcactatcaacggttaattattatttctaatcatccgtcagtcttcataatattctgaattaaattcgacatgtaggcaatgatacagtagccattgtgagttatctgtgaaatgaaagcataatatgcaattacctatgtgtggaatattttattattaggtgccgtttaacctttttatttaacttaattccgaatgtttacgctgaatagccacctttatggtggttattttgtttgcgtactcaggtcaatcaaacattatctttatacccgtcgcccttcaagatacaggggtgacaactgttattgacacttagcgtcaggagcagatttgaacgctgcttgctgcggtctcgagtaacgagcgcacatgcagcttgaagtagggtgggtatatttatacctagataaatatctttaaatttaggatgttagattggctgaaaagcatttttatgagtaatagagtgttcccgtgagccatggtgcttttgcataaaaaattgtttaacttcagggataaacgttccatcagaaagaaggtgttacatccagcaatgctttctccaatcttagcgatataacacaaatattcttcctaccacatgcttctgcaagtagagtgctagttggtacgcatctaattaagtaatcaatgtaataagaacatgatcaaatagatcggtttggcatatttcagtcttcgctatgtaccctccagtcatatcgttatattttagttattaaatgtaaaccatatgtatgtgttcaacctgaaagataaatgttcactgtggcgtcataggcaccaaacaataaatcggggagataatatccccttacttatgttaaagaatggagccatatgccaataaattgagcaatgagcaacttgatcagatgtgtccattcacataggcataaaaaagcagaattggatgacaatttctgacaagcacaaacaactattttgagccactattaaactcaaggtgagcaagagaagcagtgcatggaaaaaccactagcaggtaaaaatattttagttgtcgaggatgaagtcgtattccgtaccgtcttggcggaatacctcggctcacttggcgcgacaatccatcaggccgaaaatgggctggcggctttatatcagctaaaaggtcactctcctgacttgatcctttgcgatctggctatgccgaagatgggggggattgagtttgttgagcagttactactgaaagggataaagatccctgtattagtgatctctgcaactgacaagatggcggatattgctcaggtattacgcttaggcgtaaaagatgtgctattgaaacctatcgtggatttgaatcgtttacgtgaagctgtattggcctgcttgtatcccacattatttacttcccatgctattgaggaaacagagctcattcaggattgggaggctttacgcaaaaatccacgtggtgccctacaattgttaaaacagttacagcctccagcgcaacaaacccttgctcattgtcggataaattatcgccagcttaccatggtagaaaaaccagggttggtactcgatattgcagcgttatccgataaggatttagctttctattgtttggatgtcacccgtgcgggtgataatggggttttagccgcattattattacgtgtactatttaatggcatcttacaagaacatttaacacaccaacagcaacgtttaccacagatgtcatctttacttaagcaggtcaatctactattaagacgtacgcaccttgatggacagtttcctttattagttggttattaccatgttgagtatcagaatttaattttggtttcagccggtttgcatgcaaatatcagcgcgggtaaaaaccagattcagcttaacaatggtgtccctttagggaccttaaaaacagcacacttaaaccaggtcagtcagcgctgtgaagcatggcagtgtcaggtatggggcggagggagccgtttaaggctgatgcttgctgctgaagaatagtcatctcaataatagttttttgcttcacttcctttttttccccaatgagttaaaccttcccttgtttataaatggttttataacaaaccagtaaaatcagcctaactgacgtcaattgaagtgtatggtcgtatcgcgagaaatatcgatagatatacgttcgcgacgacttgagtctaaaaatttacattcagacatattattaattttcgataacagtttgtcacctcaggataaattaaggttaatttccgataatcactgggagtaagtctggtattgaatttcaactcggagatcgagcgaatgaaggttacggtttttggtattggttatgtgggacttgttcaagctacagtgcttgccgaggtggggcatgatgtcctttgtatcgatattgatgctaataaagttgccgatttgaaaaaaggccgtattgctatttttgagccgggcttggctccgttggtcaaagaaaactatgaggcaggcagattacagttttcaacagatgcgcaagctggtgtggcacatggcgtcattcaatttattgctgtgggtacacctcctgatgaagacggtgctgccgatcttaaatatgtccttgatgtggccagtaccattggcacgtatatggactcacctaaggtcattatcgataaatctacagtgcccgtggggacagcggataaagtacatcaagttatacaagctattttggagcagcgcggtgagaagatagattttagtgtggtatcaaatcctgagtttttaaaagagggggccgcagttgctgattgtaaacggcctgaacgtattgttattggtattgatacggatgacagtggtgctctagagttaatcagtgaattatacgaaccttttaatcgaaatcatgatcgtatgctagtaatggatatccgtagtgcagaactgacaaagtatgctgcaaacggcatgctggcaacgaaaataagtttcatgaatgagattgctaatattgctgagcgattaggggctgatatcgaaaaagttcgacagggcatcggttccgattcacgtattggataccatttcatttattctggttgtggttatggggggtcttgtttcccaaaagacatccaagcattaattcgtactgcagaagataagggttataagccccagctattgcaggctgtcgagcaaatcaataatcagcagaagtataagttaactgaattcattaaaagtcattttaattcgcagttagctggaaaaacatttgctgtctggggattggcctttaagcccaacaccgatgatatgcgtgaggcaccgagccgtgtggtaatggaatcattgtgggaagccggggctacaattcaagcatacgatcccgaagcaatggatgagacgcaacgcatttatggtgcaagagatgatttgagattaatgggaactaaagagtctgcattacagggagctgatgccttgattatttgtactgaatggcaaagttttcgtgctccagattttgatatgatcaagtcaaggttaaagcaccctgttatttttgatgggcgtaatttgtacgatccagaacgcctaaatagtcgtgggttcacttattatggaattgggcgtggtgtttcgattaatctatcatagtaagtgagaatgctgattttatgtgttgattacaaaacgttagttaaattttcgcacttgattttcatgtgtatgaccgaaaatcagtcgctaacagaacaagcacctaatagcgtaaagcgatacccttgcttcgaattgggcagttatatagattattatattgctataggttagcaaagtattcgcatgaaattgcaaccgaatcgatagatgagagttattcgtacaaaataatacattttgaattatgttactcatcataactatgttgctggctaaaagtatggtgttcagtggttgtatgttaattcagcggctgtacagtggacatttcaacggtgatgacatcggtcagttaaatgaaagacaaaaaaacaccctcctattaataggagggtgtttcgatagtaatagctaaagaaataaaactattacaacaggaagtcatccagtgatttgccttgctcttcaatggccttcttaatcactgcaggagtacggccttggcctgtccaagttttcagttcgccattctcatctttatactgatatttagcaggacgtgcagcacgttttgctttaccagcagctttagcagcagctgaagcttgtagcagttcatttggatcaataccgtcagcaataagcatttcacggtattgttgcaatttacgtgcacgctcttcaatttctgcttgtgattgagattcttcttcgcggcgttcattaacgaccacttcaagcttctcaagcatttcttctagtgtttcaagagtgcattcgcgcgcttgagcacgtagagtacggatgttgttaagaatttttaacgcttcgctcattgtcctagtctcaaattataattggtgggggggcgtctggataataatagagtgctattttaatttctgcaatagccaatttgattagcatactagaatttacgtattttattactgaaaagtagccagtcactacaaataaacgagaaagagttgttattctctgacctatttttaacacaaattttcgttttgctgccaaatgcccctacatgtaaacatgacttttttactggcttataagtttactttatatcaataaagcaagaaataggctgtttctgtatcgttatgtacaataaccggtagcgtcaggaaagtgagatatagttgtaaagaaaagtagagtaagtcaaaaaacgtgttgtattgagtattagtgctatctgccaatatttgttatcactatttctcaaattaatcgtgaaaacacattacctgtatcattattgaaccaatgaagctgtctgcatacccagcaccatttatggtgctcatctatcgtttggttaatgttcaatcggagaatgtatcatctgattattgtgagattgctcatataaagtacttaataattgaagatatgtttcaactgaaatccataatttgcttcattagtgatacctgtacttaatagagaaaacagcaatatagcagagtaatgggttcaacgcagagtctgagtttatgataaactgaatacatattgtcaatatgattatttattataccattggagtgacgggcccatggctcaactttacttttattactctgcaatgaacgcggggaaatccacagcacttctacagtcctcatataactaccaagaacgaggtatgcgcaccttggtgtttacggctgagatagataaccgctttggtgtcggaacggtaagttcacgcattggcctctcttctcaggcccagctctataatagcgggacatcattgttatctattatcgccgctgagcaccaggacacacctattcattgtattctattggatgaatgtcaatttctgactaaagagcaggtccaggaactctgtcaggttgttgatgaattacatcttcctgttctttgctacggcctgcggactgattttctcggcgaattatttcccggtagtaaatatttactggcgtgggcggacaaattagtggagttgaaaaccatttgtcattgcggtcgtaaagcaaacatggttcttcgcctggatgagcaggggagagcggtacacaatggtgaacaggtcgttattggtggcaatgaaagctatgtttctgtctgccgccgccattataaagaagcaattaaagccgcctgctgttcgtagtatccctaatcactaattagtgacagtagaatacctcactggctttattatatgatcagtggggtattgggctcttcgccagttcattgccttacaaagcatttcacggtgctctgatagtattagatgtgtttgggtaacggtatctctctaatcgcgcatttcttctctcactttttgtcaataaaatgggcctgagtgggggcgattaattattggggggaccgagttcaatcctacaatatcttccctgtccagcccattcagcaatattgtcttatgatatagctgtttgaccctacaaatagttctgtgtattcagttgcacaaggtaattatcgtaatgcctctgccctaaataattcgcgttacaggaaggtggaaagcgagagacaaattgtctggaacccatttgaaccgcatttatgctgtccgcagggtaagccgcaaggatgaggcgcattaatcccgatgagctgagtgacttttttaaggtcaatacccgtaagtgattcgggtgattgaatgtagccaacacacatgtagcttgaagtatgacgggtatataggcaattaaagagtgaaaaggcggatagggtgttgaacaacgcggaactgtaactcgctgaaagtatcattttgtttaattggtctgtaaaagaaaacccccgatcagcggctgctcatcgggggttatatcattttttgcttaccctatccgaaaatgcgggtaagaccttcaggcaacaattactttttggtctttttctcagctttaggcgcagtagctgccgcgacttcttcttcgcggtcaaactcttcaacatattcgcgaccgtaataagtatccataaggatctgtttcagctctgagatcagtgggtagcgtgggttagcacctgtgcactggtcatcaaatgcatcttcagacaatttgtctactttagctaagaagtcagcttcctgaacacccgcttcgcgaatcgatgctgggatacccagttcagctttgatttcatctaaccaagccagcagtttctggattttttgtgcagtacggtcgcccggtgcgctcagccccaaatgatctgcaatttctgcataacggcgacgcgcttgtgggcggtcatattggctgaaggcagtctgttttgttgggttgtcattcgcgttgtaacgaataacgttagaaatcaacatagcatttgccaagccgtgtgggatatggaactcagaacccagtttgtgggccatagagtgacagacacccaagaaggcgttagcaaaggcgataccggcaattgttgctgcattatgtacacgttcgcgagcaactgggtttttagccccttcgttgtagctggctggcaagaattctttcaacagcttcagtgcttgcagcgcctggccgtcagagtattcattagccagtacagacacataggcttccagtgcgtgcgttactgcatccagaccaccgaaggcacacagagacttaggcatattcataacaaggttggcatcaacaatggccatatctggtgtcaatgcatagtctgccaatggatatttctggcctgttgcgtcatcagtaaccacggcaaacggggtgacttctgaaccggtacctgatgtggttgtaatagcgaccaatttcgcttttacacccattttcgggaacttataaatacgtttacggatatccataaaacgcaatgccagttcttcgaaatgcgtttcaggatgttcgtacattacccacatgatttttgccgcatccatcggtgaaccaccacccagagcaataataacgtctggcttgaaggagttcatctgctctgcacctttacgcacgatactcagggtagggtcagcttctacttcgaagaaaacttcagtttcaataccgtgagatttcagtacgctggtgacttggtctgcataaccgttgttgaacaagtagcggtcagtcacgatgaaggcacgttttgcaccgtcagttgccacttcttccaacgctataggcagagagccgcgacggaagtaaatagatttcggtagtttatgccacaacatgttttctgctcgcttagccacagttttcttgttgatcaagtgtttcggaccgacgttttcagagatggagttaccaccccaagaaccacaacccagcgtcagagacggtgccagcttgaagttatacaagtcaccgataccaccttgagaggcaggggtgttgattagaattcgggcggtcttcattttatcgccgaaatatttaacgcgtgcagtctggttatcttggtcggtgtacagacaagaggtatgaccgataccgcccatctccaccagtttctctgctttttcaaccgcttcttcaaagtttttagcacgatacattgccagtgtaggcgacagtttttcatgagcaaatggctctgattcatcgacaactttgacttcaccgataagtatcttggtattacttggcactttaatgccagccatctcagcgatcttagttgctggctggcccacgatggctgcgtttagaccgccatttttcaggataatatcctgaacggctttcaattctttaccttgtaacaggtagccaccatgagaagcaaaacgctcgcgaaccgcatcgtaaaccgagtcaacaacgatgatggactgctctgacgcgcagataacaccgttatcaaaggttttagacatcagaatagatgcgacaacacgtttaatatctgcagtttcgtcaacgacgactggcgtattacccgcacctacgccgatggctggtttaccagagctataggccgctttaaccatacctggcccaccggttgccagaataagattaatgtctgggtgatgcatcagttgattagataattcaactgttggagcatcaatccaaccaataatatccgctggcgcacctgctgcgatagcggcttgaagcacgatatccgcagctttattggttgcgtctttagcgcgtggatgtggggagaagataataccgttacgtgtcttcaagctaatcagtgctttaaaaatagcggtagacgtagggttagtggttggtacgataccgcagattagaccaataggttctgcgatagtgatcgtcccgaaggtcttatcttcacacaaaataccacaggttttttcatctttataagcattgtaaatatattcagaagcaaagtggtttttgatcactttgtcttcaacaatacccatgccagactctgttacagccagtttggctagtggaatacgggcatccgcagcggctaatgctgcagcacggaagattttatcaacttgctcttgcgaaaagttggcatactcgcgctgggctttcttgacgcgtgctactagctcgttaagttcagcgacattcgttacagccataatgctctcctgataatgttaaactcttttaataaatgagccgttgaagcaactagtatagacaggctatagcgtgctgtatggtcgaatagagatagtttttataacttattttctcattcttacggccgatttactgaaagagctcttagtctgcttagggtaaaataaggagggaaacacttatttcaacctcaatctctcacttttttagtggttctatgttttatcacggctctgagcttaactattcttaggtatgattttcgtgatttaaatcacaaaaacatcaagctgacaccattcagcattcattttttgagaatgattgtcattatcgccatttgggtggtgtttaatgacgttaaaataactctgtcattactattgattaacaaaaaacattttaacgagataggataaattgattataaatgctggcttattcaatagattcctatgactaattctattacattaacgcgcggccttgctgggcatcgtcaatgcggcggtttttagtggaaaaagctgtagggatgaggtgctgagtcgtaggattaactgtttcttacttatttttacttaatagctgttctctatttaatttaaagcaatttttatggtgacaggtgacaggtgacaggtgacaggtgacaggtgacaggtgacaggtgacaggtgacagttatggcccgcagtaacggtatggtttgacgacgaaatctggcttaactaaacgttcgggttcaaccagagatattcgggtttaaccaaagagagagtgtgcgggtacattagttataatgcactgttatcggtgatatttttattagcaattctgtggagtgacgtgtgagtcaatcactgttggacctttcaggttacatcaagttttttgttggcttatttgcactggttaacccagtaggcatattgccggtctttattagtatgacaagctatcaggctgctgctgggcgagataaaacgaatctaacggcgaacttatcagtagccataattttgtggatctccttgttccttggggatgccattctgacaatttttggtatttctattgattcattccggattgctggcggaattctggtcgtcagtattgcgatgtcgatgatcagcggtaagcttggcgaggataagcaaaacaagcaggaaaaaactgaaacagcggttcgggagagtattggtgttgtcccattggcactgcctttaatggctggaccaggagcaatcagctctaccatagtctggagctcccgttaccatagctggcagaatttattggggctgactgcggctatagcactgtttgctttctgttgttggttgctgtttcgtgccgctccattgcttgttcgtctgctggggcagacaggtattaacgtcataacacgaattatggggttattgctgatggcattgggcattgagtttattgtcaccggtatcaaagctattttccccggattactttaaatcacaccattcagaattttcgagaggccactgaactattcttggtggccttctcctttttttccgctttgcatttctacatttaagcattaatttggtgcaaataatgcatttaaattagcctattgcactttaataatgcattaatctttatcttgtacgattaatatatctgactctctgtttctcctcatttaataacgaaaatttccttgcccgattaaatttagtacgtaagttgttgttaaaatgttcacatcattctatgaggctgttaggaatctatttagatgttactagtgactatcatttaatgagtggatttttgttctgcgtatgagggggatgttaacgttatgtttctttcggtccctgttgggttttttaccgtttatttattctgcataaaaaatattttagtaaataaattcaatatgttatatggatttattttaatttttcacgttaggtaatattgctgccatttactcgaaaaagagaattgcgtaacatttttgtaaaaaccattggcgccagatttcagcttctgctaattttcgggcaactttttgaaaaaagttcgcttatatttttatgaaatttagctgtagtgattattttggaatagttaatttattttgggatggttgatgcattttggaatagttgatgcatgtcgttgatagctaattgaccatcgccatagacaaaatatcaccacatgtgaggtttacgttaccgggttcgttccccaggtaacgcaaatttagaataccgtttaaaggtgagtttgcctgttcattgggcaatacataataaaatggagtacatataaacatgaccaacatcacaaagaagaatctcattacagctgctgtagccgttgcaatgagcatgatggctgcgggaaatacgtttgctgccaatgttcccacaggcgtacaactggctgagaagcaagtgttagttcgtaataatggctccgagcctcaatcgttggatccacataaaattgaaggggtacctgaatccaatatttcacgtgatctacttgaagggctggtgattaatgaccctaatggcaatattgtaccgggagccgcagagagttgggataataaagactttaaagtctggacgtttaatattcgtaaagatgccaaatggtcaaatggtgaccctgtaacggcacaggattttgtttacagttggcaacgtctggctgatcctaaaacagtctctccttatgcaagctatttgcaatacgctcatctcactaatatcgatgacattattaccggtaaagccgcgcctgacacgttgggtgtaaaagcgttggatgatcatacgctggaagtgacattgtctgagcctgttccttatttggataagctgttagctcacccgtcaatgtcaccggtgaataaaaccgtggtcgagaaatttggtgaaaaatggacccaaccacaaaattttgtggggaatggtgcttataaactaaaagattggattgttaacgaacgtatcgtattagaacgcagtcctacgtattgggataatgcgaaaacagtcatcaatcaggtgacttatttgccaatttcttctgaagtgacggatgttaaccgctatcgcagcggcgaaattgatatgacgtataacaacatgccaattgaattattccaaaaactgaaaaaagaaattccagatcaagtccatgttgatccctatctgtgtacttattactacgaaattaacaatcaaaaagccccttttacggatgctcgtgtacgtgaagcgctgaaattgggtatggaccgcgatatcatcgtcaataaagttaaaaatcagggagatttacccgcttatggtttcaccccaccctataccagtggcgcggagctgacgccgccagagtggtttagctggacacaagaaaaacgtaatgaagtagcgaaaaaactattggctgaagccgggtacactaaagacaatccactgaagtttagcttgttatataacacctccgatttacataaaaaattagccattgctgccgcctctatttggaagaaaaatctgggtgtagacgttaaactggaaaaccaagagtggaaaacgttcctggatacccgtcaccaggggacttatgatgttgcccgtgccgcttggtgtgccgattacaatgagccatcctccttcctaaatatgatgttatctaacagtagcaacaacaccacccattataaaagttcggtatttgacaagctgatagaagacacgttgaaagtgaaatcggaaaaagagcgtgctgacttgtatcaacaagcggaaatccagttggataaagattctgccattgtgcccgtgttctattacgtgagtgcgcgtttagtgaaaccttatgttggtggctacacgggtaaggatccactggacaatatgcacgttaaagatctttatattatcaagcagtaatgtatgaagggcaggcaactgagttggtggctgcccttattgcactaatgatataaagtcgtcgttaaaggctaaaggtataggcaatgttaaagtttattctacgtcgttgtctggaagcgattccgacgctatttatcttgattaccatctcattctttatgatgcgcctcgctcccggaagcccatttactggtgagcgtaaccttcctccagaagttatggctaatattgaggcgaagtatcacctcaatgatcctatttataaacagtatttcaattacttggggcaacttgcaaaaggtgaccttggcccgtcgtttaaatataaagattacaccgtgaacgatttagtttcatcgtcgtttcccgtctcagcaaaactggggtttgccgcatttatgttagcggtaatattaggtgtcagtgctggagtgatcgcggcgctgaaccaaaatacgaagtgggactatacggtgatgggttttgcgatgactggggtcgtcatacccagttttgttgttgctcctttattagtgctggttttcgccattatattgaaatggctccctggtggtggctggaatggtggtgcaccaaaatatatcattttacctatggttgcgctgtcattggcctatatcgccagtattgcgcgtattacccgcgggtcaatgattgaagttctgcactccaattttattcgaactgcacgtgcgaaggggttaccactacgtacaattgtattgcgccatgcattaaagccagcgttgctaccggttctttcctatatggggccagcttttgttggcattattacgggatcgatggttattgaaactatttttggcttaccgggtattggccaattatttgtcaacggagcgttaaaccgcgattactcattggtcttgagtctgactattttggtcggcgctttaactattttatttaatgcgattgttgacgtgttgtatgccgttatcgatccaaaaatccgttactagtactggagcacgtcaattatgttgagcaagaaaaatagcgaagctctggacgttttcagtgaaaaactggaagtggaagggcgcagtctttggcaggatgcccgccgtcgctttgtgcataaccgtgcggcgatcaccagtttggtgatcctgatgttaattaccttatttgttattttggctccaatgctcgcgcagtttacctatgaggatacggattggggcatgatgtcagccgctcctgatattgagtctggtcactattttggcaccgattcatctggccgtgatttactggtacgggttgccattggggggcgtatttcattgatggttggcgtcgctgccgcgttggttgccgtggttgtcggtaccttatacggctctttgtccggttatcttggcggaaaaatagattcgctaatgatgcgtttgctcgagattcttaactcctttccttttatgttcttcgttattttactggttaccttcttcggccagaatattttattgatctttgtcgctatcggtatggtctcgtggctggatatggcacgtattgttcgtgggcaaacattaagcttgaaacggaaagaatttattgaagccgccctggttggcggggtttcaacccgcaatattgtcttgcgccatattgtgcctaatgtccttggggtcgttgtggtatacgcctctttattggtaccaagtatgatcctattcgagtcttttttgagtttccttggattagggacacaagaaccactgagtagttggggggcactgttgagtgatggtgccaattcaatggaagtctcaccgtggctgctgatgttccctgccggtttcctggtagtgacattgttttgttttaactttatcggcgatggcttacgtgatgcccttgatccgaaagatcgctgaggagtagcgctatgacgactatcaataatcactctactgttcagtcctctgtattgttggaggttaaagatctgacggtgaccttcggtacatcagatggtgatgtgactgcggttaacgcacttaattttgccctgcgagcgggtgagacacttggcattgtaggcgaatctggctcaggaaaatcgcagactgccttcgctttgatggggctgttggccagtaatggtcggataggcggctctgcgaaatttaatggccgtgaaattcttaatctgccagaaaaacaattgaatcgtttgcgggccgaagagatcgctatgattttccaagacccaatgacgtcgctgaacccttatatgcgagtgggtgagcagttaatggaagtgctgcaattacataagaaaatgagtaaaagcgaagcatttgaagagtctatccgtatgcttgatgcagtaaaaatgcccgaagcacgtaaacgtatgcgcatgtatccacatgaattttctgggggtatgcgtcagcgggtcatgattgcgatggcactactgtgccgccctaagttattgattgctgacgaaccgacaacggcattagatgttactgttcaggctcaaatcatgacgttgctaaatgaacttaaaagagagttcaacaccgcaattatcatgatcacccatgacttgggggtcgttgcagggatttgtgacaaagtcttagtaatgtatgcgggccgaacaatggaatacggccaagcacgcgatattttttatcatccaagccacccctattcgataggtttattgaatgccgttcctcgccttgatgctgaaggtgaatctctgataaccataccgggtaatccacccaatttacttcgcttgcccaaagggtgtccattccagccccgttgccaatatgccatggatcgttgttcaacggcacctgtgttggaacattttggtgaaggccgcttacgcgcctgttataagccggtaggggaattagtatgaatgccatgacagagaagaaagtattattagaagtggctgatttgaaggtgtattttaacattcaagatggaaaacaatggttttggcagccttcaaagacactaaaagctgtcgatggtgtcacattgcgtttatatgagggtgaaactctgggggtggttggggagtcaggttgtggcaaatcaacatttgcccgagctatcattggtttggtgaaagccaccggagggagcgttgcctggctagggaaagacttgctcaatatgagtgatgcagactggcgtgcgacccgtagcgatatccaaatgatatttcaggatccattagcgtcattaaacccacgaatgaccatcggtgaaatcattgctgaaccattacgcacttatcatccaaaaatttcacgccaggaagtaaaagataaagttaaagcaatgatgcttaaagtcgggctactgcctaacttaatcaaccgctatcctcatgaattttcaggagggcagtgccagcgtattggtattgcccgcgcattgatcctcgaacctaaactggtgatctgtgatgagccagtctctgcccttgacgtatcaattcaagctcaagtcgtgaatttattgcagcaattgcagcgtgagatggggttgtcacttatttttattgctcatgatttagcggtggtaaaacatatttctgatcgggtattggtgatgtatctaggccacgcggtggagttggggacctatgatgaggtttaccataacccgcaacatccctatacaaaagcattgatgtctgcggttccaattccagatccagataaagaaagagtaaaagtcattcagttgcttgaaggagaattgccttcaccgattgatcccccctcaggctgtgtattccgcacccgttgcccaattgccggtacggaatgtgcgaaaacacgtcctttattagaagggagtttccgccacgcggtttcgtgccttaaagttgacccactgtaacttggtgattttctgtgattacgtctgcatcgttcacggcagacgtggtcaagaatataatacgaaatacttatctgttttccagggtccaacatgttgaaatctattgtatatacctgtcatacttcgagctaagtatgtgctggttattgtcgttactcggcccatctatggacctcacctctgcgaagccgctgcaagcaatgttcaaatctgctccatcaataacgcttgtcaccccagtcacagacttgttgttgacctcaaaatacataagctcctgagacttactcagttgccgccttcctgcaactcgaattatttggggtatatatttttaatttagccattcaaaaattaaattaatatttaaagcctctcgtgtaattgtatttaatttaaataaaataaattgtccgatagattttatgaattaatttattttcattagtcccattgacgaattaaaacatattaagttaatgtgtttttgtcatttaattaaatgactctttaaattctgatgtaattaacttatacatttttaatgttttattaaaggaataggatatgaaaaaattaattttactttcatcattgtttttactttcatcttctgcttttgcaattaatgagagaggtgaatatgaggaagaagactttaaaaaacactgtgataaaacagccgcgacgatagtgaagtacgcgactccagggtttaatatcttctcaatttttaaagacttaatcgagcacggtgagttgaaagatggttgcggaaactaaaaatatgttcccagatatcctaaataagagcgtctaatatcgtatatacctatcgcccttcaatatctagggggggggctgctcttgctcacctcagtcacttagttatctaagtgactgaggatttactcgattgctgcctacctgtatcttgaagtaacttgagtatatatctgcactgttaaagatatagagcgatcctgtattttagtcgtgctcttgctaaggataattaagatacattgccccggggttgaactatggggcaatgattaactctttatttttttgataactttattctttccataatatgtggcaaagcttgtgatctttctctcggcacagcagtactcgggcaaaaatatcgttaatttcctcaccatcactgtcggctaaaccgataacaacttcagcgaaaaagtcaggatttatgtcaaaatcgacatgctcctgccaatcttccgccggatcaaacaactcagcaccaccgcgctcttcaaactgaagattaaacaatagaatatcggctggatcgaggttatcccccgcgagttccagaaaaatatcgtatgcctgttccagtgtttcatcttcagtgaggcgattattgagatccatcgagcttggctcttgtgtgttctggtccatgtgcagattcccatttatcatttgcggattgtgctaattaaaacattctcgctagggtttttacaatttttatcctgcccaataccgctcattcagataatctgcaatttcgtggtcatgaattcttcggttttttacagtaatgggctgaaaaaatagaataaacgctcagttactctgtgccaaagagggcgcttgttccaccgttcaccatccaataaggcagagcgggcgatataatcatcctgaacttgtgctaaatcagccccaaagccatcatcatcaatcaccagtgtgatttcaaaattcagccacaaactgcgcatatccagattaacagtgccgactaaacttagctgtccatcgaccagaacacttttactgtgtaataggccgccttcaaactgataaattttaacgcctgcattcagcaattcggtgaagaatgctcggctggcccagcgaaccatcatcgaatcattctcacgcgggacaataatactgacatcaaccccgcgttgtgccgcggtacagatggcatgtaataagtcatcactggggacaaaatatggcgtagtcataattaactgttcacgtgcggcatacacagctgttaataatgcctggtggatcatttcttctgggaaaccagggccagaagcgatgacttgaatcgtatgaccagtctcttcttcgaatggcataatattcgcgtcggggggcgggggtaaaatacgtttgcctgtttcaatttcccagtcacaggcataaacaatacctagggttgtggctaccgggccttccatgcgcgccatcatatcaatccactgaccaaccccggcatcttgtttgaagaaccggggatctaccatgttcatactgccggtataagcaacatagttgtcgattaacacaattttccgatgttggcgcagatccattcggcgcaagaacatacgaaatacattaactttaagtgcctcaaccacctcaatacctgcattacgcatcattgcgggataagggctgcggaaaaattgcttgctacccgctgaatcgagtaacagccggcaatgaacgccgcgtcgagccgcagccatcaacgattcagccacctgatcgaccagaccaccaggttgccaaatataaaacaccatttctatattgtggcgggcgagttcaatatctcgtactagcgcttttagtgtgtcatcggttgttgttaatagttgtagttgatttcctttaacaccgtttattccttgacgccgttcgcataattgaaacagtggggtggcaacttcgctattagagttagcaaagatatgttggcattccttgagttcactcagccagcgagcggtcgatggccacatggctttagctcgttcagcacgccgcttacccaaatgcaattcaccgaatgaaaggtaagcaattatccccaccaatggcagaatgtagataatcagtaaccaagccatagcagaaggaacggccctgcgtttcatcagaatacgcaatgttaccccggcaatgagtaaccagtagccaaaaacggaaagccaactgattacggtataaaatgtcgtcataagggcgtaaatcctgttcacaaacggtcactaaagagtgtacgcacagtatcgagaaggtgaaacctttaatcggttatattgatgtataaaatcttttcatctaaaaggacttgcaactctcgataaaatgataaataggaggttattgacaaagtgcccgcgacggagagaacaggcagatcgtaaagacgccgtaaatacatccatgtaggctcgagccgcgccatccttggcgcggacgctttactcctctgcctatcctcaccgttcaagatcgcgtcatcggggtttgtcagcagtctgaaatagatcattatttatagttttgagggcatgtcgggggcttttaatctgggccgctattttaccacttacggcttggcgctgaggttgaaaagcttataatggatgggttttcggctttggaagaatagtttcatgagacggagtagaaatgaagttggtcgctggcgtatgctgcgacaaaatcaacggcgtaaaacccgctggcttgaaggccaatcacggcgttaccggcatatctattgtgtcaggcaactccacgagcatcagcatcgtagggcgttgttattcaccgtagcttatgagtggtaagaccctattatggtaataaggcagtctctatgaggctgtttttgttttgaatctttccctgaaaatagacaaaatagttttgcatttaaatatttcatgagagatatttatcatggttaattttatgcggatagcggatagcggatagcggatagtttgattttatttttataagtcagtcatctaaatataagactgtttttatttaaaataagaataaattatttattaaaggatctatttacacaggttgctaattgacgatctaaaaaatgacgtttattattcttgcgactctctttgttggttttattctgattgtctttttttaataactctaatcatgagagttaataattatctgaataattggatttgcaataaaatcaactataagtttcctgccttatcaaaaattaacttttaataaatggaatcattatgaaatggattacgacattagcgcctctttcactcgcattatctttgggtatatcggtggcgaatgctgccagtgatgctagcaacacggtatctttcggttacgctcagagtacgctaaaaattgatggggagaaaattggaaaagataataaaggttttaatctaaagtatcgccatgagttggattcagtacttggcattgtcgcctcttttacccataccaagcaaaactacggtatgcctggagatagcgatgggaagagaaaggttgagtattattctttgatggtgggtcctagttggcgctttaatgaattcgtcagtgcctacgcattaataggtgcaactcaaggtaagagtacacacactaagccgcgtatggtaagcaacactgttagcaaaacaagcatggggtatggtgctggcttgcagttcaatccggtaaaacacgttgctattgatacagcttatgaatacgccaaaatagaggatgtaaaaataggaacttggattgtgggggttggttaccgcttctaatattctgttgattaacgcagataaccagaatgacttactggttattattacttttatgccaccttataaactcggtggcttttacattcggataacaaaatagacatagataaaagttagattttgtatgtcgggtatattaatttgcagtgaatatcacagttatataattctgattagcagatgatgtgataccgattacagcaaaggctatggtttatgtctcagtataaattagctaaaacagtattctttggggacttgaaagtcagcgccgctctctataagtatgaaatttattgtgaagagtcagagttgatttaccacgcggccatttattctgaacaagttattgctgctggtaaacacacctatccagtttgggtcagaaaagatcatatgatattaaaatcaccagcacatatcttggagaaggccgttgaggcttgcgaagagcattggctgaaacactacaaagggtagcgttatgctgaggttttctatcgtggttaattaacaaaaaaaacttataataatacgcctagctttaggcgtattattatatctagtgtctacaaccgtgggctgtttaataagactaatcaaaaaaacgagataagaacccttttttctgtagtgcttggattttgagtatccgtgattaccatgctctctctcatcagagaatgaggttgctggtgagttttctaccgatttttcaatgagcttgtctaatttcccgcgatccaaccaaacaccacggcaatttggacaatagtctatctcaatacttttgcgttcagtcatcactaactgggtattattgcacaccggacattccatagctttcatctccgcattaaatcaacgtgacctgagtttgtgcgatatagaaactgtccttaattagacaatgattccaggtaattatgtgtaagtgtggttaaattaatgcggtgaatatgtaaaattcatgattgtagggaggatgattgtagagagcatgattgtagagagcaacgcgtatatctcggagttgatacccgctggctacacgcgtagggagaatgacttttagattcaaaacacccgtttaaagggtttaataattaccgactggtaaacacctgcggcaacataaggatcttgttcagcccatatctcagcttcttgcaatgaggaaaagtcagcaatcactgtcgagccagtaaagccggcattaccgggatcggcactgtcgatggctgggttaggtccagcggtcagtaaacggccttgatcctgtaaagcctgtaagcgagccaaatgcgcaggacgcacagacattcgcttctccaatgagttaggtacatctgtagcaaatatgacgtaaaacatttttcacctttaaaatcataataatgatagttatcaatggtgttcaataacagcatgttacactcacgaatacaaccatgggaaagctaacaatgggtgttaccacttaatggttgttatcacttagctacccatcatggaataaaatgatctctaagagtaaagataaagtgctgccacggcgagattgtggattaaaacgtcatttagcgctaattaacgagaatgtttgtcgttccttattgaacatgattgctatttgcatttaaacttggctgcatcagaggacattgaatcattatgcagctaataaaatttttctcagatcgacggttaacatggtcactcattttttcaatagggttgcacgggagtgttgttgcggcactgctgtacgtttccgtagagcaaatgaaaattcaacctgaaattgaggatacgcctcttgctgtaacgatggtcaatatagcggaatttgctgcaccacaaccggctgccgccgcgccagagccagttcaagaaacaccagccgtgcccgaagagacaccgcctgtgcttgaagagacaccaccggaacctgaagagctgcctgagcctgttcctgaacccgtgaaacccaagccgaagcctgttaagaaagaagttaagaagccggaagtgaagaagacgcaagcaccgccggatgacaaaccgtttaaatctgatgaggccgcgctggttgcgaacaatgcaccggtaaaatcggcaccagttgcctcaacacctggcttatcaacatccgctgggccaaaggcactgagtaaggctaaaccctcttatccggctcgagcattggctttagggattgaagggcaggttaaagtacagtacgacattgatgagagtgggcgagtgacgaatgtcagagtgttagaagcaacaccacgtaatacttttgagcgtgaagtgaagcaggtcatgcgtaaatggcgttttgaagcggtcgctgctaaaaactatgtgactaccattgtgttcaagctcgatggcaaaatggaaatgaattaaataagactgtcaccaacctcagggccgcttttgcggcccttcttgtttaatcaatactctcacattcattattgagtcgcacctacttcgaaattacctttaccgctcggtaatccacggggtttacccgcatcatcaaccgcgacataggtgaataccgcttcagtagcacgataacgctgcccgattggctcagaagaaaccttttttacccatacttcaatgttaatggtgatagagctgtgtccggttttaatacagcgtgcatagcagcaaacaacgtcaccaacagccacaggcttaagaaacgtcatgccatcaacacgaaccgtcacaacgcgaccctgtgcaatttctttagcttggatagcgccaccaatatccatttgagacatcaaccaaccgccaaatatatccccgttggcgttggtgtctgctggcattgccagagtgcgaagcactaactcaccgttaggtaatgaaagttcaccgccagatagttgttgttcctgagtcatttctgtctgcttttaaaagttaatccactgactaagggcggcccactgagcgttcagtgagcatcaaaataacgtttatttaagacttcttctgctcttccggcatatggcgataaatataaacgccactgatcaacgtaaatatcagtgtcagagcggttaagccgaaaactttaaagttgacccaaatatcctgaggcaaccaaaatgcgacataaatattcagtagcccacagaccagaaagaaaatggcccacgacaggttcaatgttgaccaaaccttgtcaggtaaggttaactctttacccaacatccgttgaatcaacggcttcttcatcacccattgactgactaataaagccaaggcgaacagcacatataaaacagtcactttccatttaataaacaagtcactgtggaatgcgagtgttaatgtaccgaacaccagtaccatcgctgcagtaaccaatgtcattttttcgactttgcgatatttcagccaggtaaaggccagagctaccaaggtggcaacaatgagtgccccggaagcgacaaaaatgtcgtacatcttataaaaaataaagaacacgactaatgggagaaaatctaaaagttgcttcatgaatcaatccatcatttgtataccgcccgaatataccggattcagcagggggagggtatccgtagtaaaagcctattatcgttaataatcaatctgaatgctcgccttgtcggcagaatttgcagaaacttacgaaaaatcagtaaggaacacggtttgcatattgccagtgatgagctaacccagcatgatgaaagataaatgttgggttgaggcttggtggaatatatatgcagaaaaaatcccttcggtattggatgccgggtttgacccaattaatggcctatgagcgtgattggataaagcctgacctccgagcggggttatcggtagccgcagtcgcattacctattgccattgcttatgccgagttgacgggcgttagcgccgcagtcgggttgtactcctgtattttgccgatgatagcctatgcgttttttggttcatcgcggcaattaattgttgggccagatgccgcaacctgtgcagtgattgcggctgtggtagccccgttggctgcagggaatagtgaggttcattggcaattaaccatcatgatgacgttgatgatggggtcatggtgtctggtcgccagccgctttaagctgggagcgttggcggatttattatcgcggcccatactaaccggtttactgaatggtgtggcgatcacgattattgtcgatcaattaggtaaggtttttggctttatgactcgcccgccacagctcattgaacgagtcttggcgctcccctataacatgtttaacagccatttacctacggttgccatctccttactgacctttgtggtgctatatggggtcaaatggttgagacccaattggcccgcacccttgctggcgattgtcatcgcaacctttgtgtcttgggccgctaatatgcagcaatttggtgttgatgtggttggcggttttgagggggggttacccatagtacattggcctgattttcaacccggcctgttacgcgatatggtcatcccagcccttaacctcgctgtggtcagttttgtcagtatgatgctcaccgctcgcagttttgcagcgaaaaatggctatgacgttgatgctgatgttgaacttcgtgcattgggtattacgaatattgtttcagctttatcacaaggttttgctattagtggtgccagtacacgcacggcggtgaatgatgctaacaatggtaaaagccagttggtttctatcattgcggctctggtgatcgcgatggtcctgttgttcttaacccgcccactgcaatttattcccattgcggcattaggtgtcgtgttgatttacgctgcctggtcattactgagctttaaaagtttgtggcaactgcgtaaacgcaatactcaagctttctatctggctatttttacatttgttagtgtggttttggttggtgttatcagcgggatcggcctggcggtattgttagggctgttgcaatttttgcggaccgtattccggccgacagagcaactgttgggtgttaacgctgatggcatgatccattcaatgggtaacggtaatggtattaaagccgttcctggggtaatgatttaccgttttaactcaccactgacctattttaatgtcgcttattttaagcggcgcatcctgaatttggtggatagcacgccacatcctgctgactgggtcgttattgatgctgttgccagtttcacctacgctgatatcagtgtattggccgccattgatgaacttaaacgtgaccttaagcagcgaaatattaaactgatattagcggggcgacggacagaattaacccgctggttccgtattaatcgcctgaaaagccatgatgacgatttggtcttggtcccggatttatatctggcgcttaagttgattcagagtaaacggcgggtagcagagaaacaggaacacgagtcagaaacgggattggaacctgagataggctgacagatatcgttctatgagtatcgatttcactgtctacagtttgaacgcctgatgtaatacatcaggcgtttttgaatgatacaacgtcaaactatggcaaaaattatcatttatctctgattactgtttatccagtgaaactgggcgtaacagcatatacaggcggaataaatagaccagcagcaatgcagaagccaaattacttaacgtacttaaaacgatggtagctatcgtaggggggagtacagtaaagcggctaattaagaataatagaagaagtttaacggctatccataacatcatggctggcacaatcaaccgcacattggcaaatgccaactgagcactggctttcattgcagcaaaaattcccattctctcattggtgacgatgatgggtgacaatgaaagtgcgatcgcgatggctacgcctggcacgatgaagaatgttaacccgagttgaatgaccaaggtactgataaacatcaataccagtaagcggggtaagatgggcagagagagacctatcgcctgtaacgcactgaccctgcggccctgagaaaccattgcaatcagagttaacaacccaccgactaataatacattacccaccaatgctgagaacgtggccaccgcagagacccgcaatagcaccatctgctgctcaggtgtcatctgtgacactatctcactgatgctaagatttcccgatgacgtaatatcattctccggaatacttaaaatactcagttgttctgaagcgggcataaatgtctgattcagcatgacggtaataaacgcagtcagtagggccaacagcaggatcgctgctatctgattacgtaaaaagttaaaactgtcacggtataaagtgttagccgtgataggcatgaaagctccttgggatcgaaagaatagcgcttagtgggtgattataccttgttatgggcgttgtgggatcctgtcattagcctgtagcgggtttcttctaattttatttccccgaagttatgtcgacatagcggtatccatccccatgaattgattaacaaatgcacatgttgattttactgtttatttctaatcgaccggttgcccggcaaagtaaaccgccagtttatcgcacgatgtctcaaacacccgtcttgatgttgatgggcgttgtccagtgttcagacaatggcagcataggtatgataaatggcaatttggcttttatgatccagatcaatttcaatattattaataaattaaataaccatacataaaataggatttatttaaaaagatacgaaagatgtgatctcgattagatcacaaatactcatttgtaggtatattcacccccgtaaatatacctacaaatggaatggataatgaaaaaaatcacgttggcactgctcgccgtggcctcgttagtacctacagcagcaagtgcacatgaagctggcgattatattttccgagcagggacggcaaccgtcagacctaatgccgggtctgatgatgtgttaggtaacggttccttcaaagtcgataacaatacccagttggggctgaccttcagttacctgatcaccgacaatatcggtgttgaattgctggcagcaacgccattcaaccataaagtggggctggcaggggtagggacgattgcggatgttaaacaactgccgccaacattaatggcgcaatactatttccgtgataaacaagacaaattgcgaccatacctgggtattggtctgaactacaccaaattctttgacgaaaaattcaactcgacaggctcagatatcggtctgacgaatttaagtgttaaagattcatggggtgttgcagggcaagctggcatggattatatggtcagtgaaaactggatgctgaacatgtcagtctggtggatgaacattgaatccgacgtgaaatttaatttggcaggtgaagagcacagcatcaatacccgtttggacccatgggtatttatgtttggcgcaggttatcgtttttaattacccttcagactttaagctgtagcgagttagcgacactcactgacaggaataagctcattgggattgccgacctgcagcgctaatgagtttacatcagttaggcgggcagtaaggaggcgcggttatgcgcctcctcctgttttttacttaatcagcatttgattactgactgactttacacccggtaccgagcgggtgacttgtacggcccgattcgcatcctggcttgaactcacgaagccacttagctgaacacggcctttaaatgtttcaacattaatttctgtcgattttagattcttctcgcccaataatgcggccttcactttcgtcgtcactaccgtatcgtccagataaccccctgtgccttctgatttcgcggttggcgcacaagctgataccgccatagccataatgatggcgatacacaaagctgaaaaggtcttaaaaaacttcataaatgactctccatgtttacctataggttaaaggagcttagaggacgttgcgggatagctgaaggatatatcgactaacacgctaagcgctatcacggttccctcatgacatatcaaacgtaaaaaatgcttagcgtattagctaattattggttatgaattgcctttattcaaatttgctacaaatttataacggaaatagcccaagaaatggctgaaaatagcgcctgtttcatgtaaacaaacaggcgctgaagggcggtaatgacagcagttaacggtaaatagtaattaattctaaacggtaactcactatcaatagtaaccaattgtaaataataactagctgcgggttgccgctttcatctctgtgacgaagcgggttagctgaactaacatttcaactggttgtgcaacatttttttcaatgattttgacgattgctgagcctgaaatagcacccgccgcgcccgccgccaggctggcttttacttgcgcgggttctgaaataccaaagccctgcaatgcgggcgctgcattatattcacgcagtttatctaccagatggtttaacggtaactggccgtgattttctgcaccggtgactccggcacgtgataacaggtaagtgtaaccacgaccatgagaagcgatttctcgcagtaagtcatcgtcggcattaggcgggcagatgaaaatgggtgcaatcccgtgacgtaaggccgctgcccggaaaggggcagactcttcaaatggcacatcagcaattagcaccgaatcgacacccacctcagcacagcgctggtagaagtgatcaataccattgtggaataccagatttgcatacatcaacaggccaataggtattgtggggtgtttttggcggatttcggccagtatttcaaaacaaatagccggagtgacacccgcagcaaaggcacgcaacgccgcattttgtatggtagggccatcagccaacggatcagagaacggaatccctaactctaatgcatctgcacctgccgcaattaacgtatcaataatattgagtgacatcgccggagagggatcgccaagctggacgaaaggaacaaaggcaccttcttttttggcggctaactgcttaaaaagttgctgataacgctccattaaatctctccccgtgctttcagaatatcgtgaacggtgaaaatatctttgtcaccccggccggagagattcaccaccagtatttgttctttatccggatccgctttaatcattttcaacgcatgtgccagagcatgagaggactctagcgctggaataatcccttctttacatgacaatgtcttaaatgcgtctaaagcctcatcatcggtaatggagacataatcagcccgcccaatactgttcaaataagcatgttgcggccccaccgaggggaagtccagaccggcagaaatagagtaagattcttcaatttgcccatcgctggtctgcatcatcggtgatttcataccgaagtagataccgactttaccgtgttttaggggggcaccatgttgcccggtttcgatccccaagccggcaggctctacgccaatcagacccacatcaggctcatcaataaaatcagcaaacataccgatagcattagaaccgccaccaacacaggccaatactgcatcgggcaggcggccttctttttccagtatctgagccttggtttcttcaccgatcatgcgttggaattcgcgcacaattgtcgggtaagggtgagggccagcggcggtacccagcatatagtgagcggtttcataagtacctgaccagtcacgtagcgcttcattacaggcatctttcagcgtcgatgaaccactatgcactggaataacctcggctcccatcaggcgcatacggaaaacgttcggcgactgacgttcaatatctttcgcccccatataaatgcggcattttaaacccagcaatgcacaagccagtgcggaggcaaccccgtgctggccggcaccggtttcggcaataatttcggtcttacccatgcgtttagctaataaagcctgacctaaaacctgattggttttgtgtgcaccgccgtgcagcagatcttcgcgtttcagatatagcttggtctttgtccctttggtcagattttgacacaaggtcagggcagtagggcgcccggcatagttttttaacaaatcttgaaatgcggcctgaaattcaggatccagttgagcactgacgaatgcgtcttccagttgcttcagggctggcactaaaatttggggtacatacataccgccaaattcgccaaaatagggattaagtgtcgtcatttttctgtccgttatgcgttggtttatcgggttaaccaaagtaagttcatatccccttggtatttgaagccgcagcggtgttagctgcgacgccaattatttttgggataaagtaaatcttgaaatagagtaaatcagtacacgcgtaatgcctggaatacagcggcgatccgttgggggtctttgatgccaggggcgctttctacgccggaattgacatccagacccgcacagcctagttgggccgccacatcacagttctctggccccaaaccgcccgccagcaagacattatccagtgcctgatctgccaataaggaccagtcgaaacgttgccctgtgccacccgtaccgtgatccagtacgtagcgttcaacttgctgtaagttgcgttccggcatcgtgtcaccgacactcagtgccttccaaatctggcaacccgcaggtaatactttgcgcagttgattgatatactgttgatcttcatgcccatgcaattgcactgctgccagtgagagttgttcagccgtttgccgtacagtttctatttcagcatgacgaaaaacaccgacatactttagcggcgcaccactgataaccgtacgggcgctggcgatatccacataccgcggtgaactgttgacaaaaatcaacccgccgtacaccgcacctgcgtggtaagccgtggcggcatcttgtgcgcgtgtcaggccgcaaactttattttcgcccagtaacacccggcggacggccgcgttgagatcgggttcggacatcagggcactgccaatcaggaaaccgttggcaaattggctcaattcacggacctgacgataatgactaatgccagattcactgattattgtgacaccttctggtaggcgtggtgccaattcacgggtgcgattcagatcgatagacaggtcacgcaggtcgcggttattgatgccaacaactttggcacccaaggtaatagcacgctccaattcttcggcgttactggcttcggtcaacacccccatgttcaggctgtgtgcgacggcggccaattggcggtaagcctcatcgtccaagaccgacagcatcagtaaaatggcgtcagcgtggtaaaaccgcgctagctgaatctgataagcatcaataataaaatctttacacaataccggctgagtgacggcggcactgacttgtggcaagaaatcaaaactgccctggaaatatttctcatccgttaatactgagatagccgacgcatagtgcttataaacaccggcaatctccgccgggttaaagttgtcacggataacccctttagaaggtgaggcttttttgcattccaaaataaagaccgttttatcgccttgtagcgcgtgataaaaatcgcgctgactctgggtgatttcgttttggaagcgggttagaggctgttgcagtttccgcgcggcaacccaaatttctttatcgtgtacgatttggtggagcacggttttggttttatcactgtcaactttgtcactgccaacgttataaccctcggttttgtaacccccagtttcctgcatgatttatcctctcgctgccagagcagtaacacgatcaaaagcctgaccgctgtgaatcatttccaatgcctgttgcgcattatggcgcaggttttcttggccgtataacttcagcagcaaggcgacgtttgcagcaacggcggccgcatgtgctgtttcacctttaccttgtaacaaccgtgctaaaatgtcacggttttcttccggcataccgccttgtagagcggcaagcgggtagcgattcaaaccaaaatcttctggcgtcaattgatagctttcaatactgccattattcagttcagccacctgcgtcggggcatgaatagccacttcatccattccaccgccatgtaccactgccgcacgttgataacccagtactttcagcgtttgagcgatcggtaacactaactcagggctatagacgccaatgagcgccagcggcgggcgggcggggttgatcaacggccccaacacattaaacagggtgcgggtctttaactgctggcgtactggcatcgcatgacgaaaacccgtgtgatattgcggcgcaaacaggaagcagaccccgagatcgtccaacgccaaccgtgattgctcggcactcatgtccaaacggataccaaatgccgccagcagatcggatgaaccggaacggctagaaacactgcggttaccatgtttagccacttttacgccacagctagccgcgacaaaggcactggcggtggagatattaatactgttggtgccatcaccgccggtcccgacaatatcggcaaacaggtagtctgggcgtggaaagtgttgcgcatctgccagtaaagcttgagctgccccggcaatctccgctggggtctccccgcgtactttcatgctgattagcactgcggccagttggcttggctcgagttcaccacgtacaatcgccgcaaacagttgctggctttcttcttggctcattgactcagcccggaacagtttttcgaataaatgttgcatcataaactccttaattacgctaacgcccaggccagtgtttgttcaagtaaacgcgcaccgtgggtggttaaaatcgattccgggtggaattggtagccacaaacgcggtgagcatcatgacgaaccgccatgaccatctcgccaaaacgggcgttaacggttaattctgcggggagattactgccgactaaggagtggtagcgggcgaccggtaatgggtttggcataccggcaaacataccttgcccatcatgttcaatcgccgaggccttaccatgcaatatctcacccgcttgaccaacatggccgccataggcttcgataatggcttgatgacccagacaaataccaatcatcggtaactggccctgtaagcgttgcaatagctcaggcatacagcctgcctgtgctggtgttccagggccaggtgacaacatcagtaccggttgttcgagttgttgcaagcgttcaataatgttatcggcggcaatgtggttacggtaaatcacgacgcgatgaccactggaacgaagttggtccaccaggttgtaggtaaaggagtcgatattatcgagcagtaggatatcggccattagaaaatctccttggcatgatgggcagtggcaatggcgcgcagtacggctctggctttattccgagtttcatcagcttctgcttgtggaactgagtccaaaaccacccctgcacccgcttgtacggtggcgatgccgtcctctacgtaggcagaacgaatcacaatgcaggtatccaaatcaccgtgagcagtgaagtagcccactgcaccgccgtagctgccacggcgtgagccttcattactggcaatcaattgcatggcccgtactttgggcgcaccgcttagcgtacccatgttcatacacgcttgataagcatgcagcacatctaaatcttgacgcagagtgccaatcacgcgggacaccagatgcatgacaaaagagtaacggtcaactttggttaaatctgcaacatagcggctaccgggttcgcaaatacgtgccagatcgttacgagccagatccaccaacattaaatgttctgccatctctttatggtcagtacgcatttccaactcgatacggctgtctaaatcacgatcgagttctccattaggacgacgaccgcgtggacgagtacccgcaatcgggtaaatctcaatttgacggttgctggcatcgtatttcagtgcgctctcaggtgatgcgccaaacagagaaaaatcattgtcttgcatgaaaaacatgtaggggctgggattatggtctttcagtgtctgataggccgccagcggtgatgggcagggcagcgtaaaacggcgggatgggaccacctggaaaatctcaccttcacggattgctacctgcaattcactgacaacgttgcaatactcttcatctgattggttacactgtaacgccatctctggcacggaggtggcaggaatggggtgtggcgcttgttgtaactggtggctgagttgctctaaacgggtcgccaggcgctgatactctgaactgtctggcgtgaacaggctggcctgcaagcgagttgaacgatgctgatgatccaaaaccagcaatgtctcggctaaatagaaacagaagtcagggcagcgttgatcctgacgcaacggaggcaaattttcaaaaccagcgactaaatcgtaagcgaacaaaccgcccaaaaacagggcctcacgctcggcaagtggggtattaaccagtgttaataattgacgtaaagcatcaaaaacagataaggactgtaagcgtgaatcctcatcctggacttcatttattaacgggaaagttaactctcggccattcggacgaacctgaatatcgacttcagtgggcagactggcatccagcagtggtaataaagaagccccattacgggtcaatgcttcgagagtgacggtttgccctaatgccgtgatacgcaaggcactgtcgatgaccaacaggcttttcagattctgcttgttgtcaacttctgcagactcaagcaacagggtcgcggggcgggcaccacataattgatgaaacagcgctgtcgggtcatcgcggtaacaggcgctagcggttagtaactgtaaagtaggacgtgatgtttgcatcattgagtgatcctaaaaaagaggccctgaaaaattattacgctggaatctatccataaaaaaacccgctattagcgggctgaagcaatctgcactgtctgatgacggatatgcgtgattacatcgcccgagagagggagatatgccaccaacgcagtaaggaaatcagggaagtcttcattatcagtcacaactctctttgattgcattcagtttaatggcgacgctcggtttataggagcatcaccggatgtttcgtgaacttgtgtactagttaactggttcatgaggtaaatgtcaaccccgattgattgttttttaacgaactcttttttcataatcccatggaagtcagatgtaagattgattaacgttcgcgtcttgtaagcgggtatgatagccaaccctattttactggatgattgttttgagtgctgagccagcgttaccggatatgaaagaactcactgacgccacgacgttatctactgcttttacgctttatgatctacatagccatacaacggcttccgatggcacgttgacgccatcagagctggtgatcagagcggcacagatgcgtgttggggttctggctatcactgatcacgataccactgctggtttggcagaagcggcggcggcgattgaacagcatcaattagcgctacgattgatccccggtgttgagatttccaccctatgggaaaatcatgagatccacattgtgggcctgggtattgatgttcagcatgtgagtctccgtacgttacttgaggcacagtctgagcaccgttatcagcgggcccaagagatcagcacccgtctggagaaagcacgtattgtgggcgcatgggaaggggctaaccggttggcaaacggtgggcaggtgacccgtgggcattttgcgcgttatctggttgagttagggctggccagcaatgttggtcaggtgtttaaaaagtatttagctaaaggcaagaccggttatgttcctgctcagtggtgtacaatagaacaagctattgatgcgattaagcaatcaggtggacaagcggtattggcccatcctggccgttatgatttaacggcaaaatggttaaagcgtttattggcccattttgctgaacatggcggggacgcgatggaagttgcccagtgccaacaagcccctcacgagcgggcgctactgggtcaatacgcacgcgattatcatttactggcatcccaggggtctgatttccatcaaccttgttcttggattgaattgggtcgcaaattgtggctgcccgctggggtggaaccggtatggcgagattggcctacagagccagccatgccgctcgtacgttgaataatgaggtagaatcatgagtcaatttttttatatccacccggacaatccacagccccgcctgatcaaccaatgtgttgatgttttacgtaagggcggagtggttgtgtacccgacagattctggttatgcccttggctgtcgtttagaagataaaacggcaatggaacgtatctgtcgtattcgtcaattggatggcaatcataacttcacgttggtatgtcgcgatctgtctgaattatccacgtatgcgtatgtcgataactccgcttttcgtctgattaaaaataacacaccgggtaattacacctttattttaaaagccaccaaagaagttcctcggcggttaatgaatgataagcgtaaaaccattgggttacgtgtgccttctaatcctatcgcgttggcgttactggatgcattaggtgagccgttgatgtcaaccacattgatgctgccaggtaatgatttcgctgaatcggatcccgaagagatcaaagagaacctagggaaacaggtggatttaatcattcacggcggttctttggggcagcagcccaccacggttattgacctgactgattctgctcctgaagtgatccgcgaaggggctggggacgtaacgccattccggtaacgcaagccccttccgataagagtctgcgagccttttggtcccgatttaatctattggcttgttaaatctatcggtttgttaaatctgttggttcaaatagacgggtattgcaaaaacaacatatctatttattagaatcattgatcctaatattagtgtaaaatgtccggccacggacaagtgtgtgtgccagttttattgatacgcgatgtgacatactgttttctaaaatgtattacaatcagtgggttatactttaatttggtccttaacgtattgattacaatatataacacgacgcctgtgaaggcgacattagaggttgctcaatgagcgagaagtcagaaaagcaaaagttaccaaccccaaatccacacacccctgctaagccacagggcgctaaaattgtgggtgaaaaattacagaaaatcctggcgcgcgctggccatggttctcgtcgtgaaattgaagccattatccagcaaggccgcgtcagtgttgacggtaaagtgtcaaagctaggtgatcgtgtagaagtgacccagtccactaaaattcgtctggatggtcatcttctttcaattaaagaatctgaagaaaatgtgtgccgcgttctggcgtattacaagccagaaggtgagctttgtacgcgtaatgatccggaaggtcgtccaacggtatttgaccgtttacctaaactgcgtggttcacgttgggttgcggttggtcgtttggatgtgaacacctctggtttattactgttcactaccgatggcgaattggctaaccgcctgatgcacccaagccgtgaagttgagcgtgaatatgcggtgcgggtatttggtcaaatcgatgatgataaaatcaaacagttgagccgtggtgtacaactggaagatggccctgcggcatttcgtactatcagctaccagggtggtgaagggataaaccagtggtataacgttacgttgaccgaagggcgtaatcgcgaagttcgccgtctatgggaagccgtaggcgtgcaggttagccgcctgattcgtgtgcgttatggcgacattaatttgccgaaaggcctgccgcggggtggctggactgaactggatcttaaagccactaactacctgcgtgaattggtcgaactggatgttgaaaccgtcagtaaattacccgttgagaaagatcgtcgccgggttaaagccaaccaaatccgtcgtgcagttaagcgccataccgaagtctcgggccgccaggttgctggccgtcagggttcagcccgtaaaggctctacgcgtcaaaacgtgggtaatgcggtacccgcagccacggcaagtcgccgtagtggcccgaaaaaacgcggttaatctcaggcggattaatgcgtcgttaaccgcgtctgtcattagacatcaatagcgacgtgaataatgcttattgccgcagttttttggactgcggcaatattatttttaacgcttataaaatattaccaatcaataccttgctgcgcttttattcctgcatcgaaagcatgtttgacgggacgtaactcactgacggtatccgccatctccagtagatcccggtggcacccacggcctgtaataatcaccgtttgatgagcagggcgctgattgagtgcgttaatcacctcatccaatggcaagtagtcgtaagcgatcatataggtcagctcatccaataccactaaatccaatgttgggtctgctaacatgcgtaaagcatgttgccaaacccccagacaggctaccgtatccgtctccctgtcttgtgtattccaggtaaaaccggtcgccatcacctgaaattcaacgccatgttgttgcagcaggttcttttcaccgtttggccactcccccttgataaactgtatgactcccgctttaaggccatggcccaccgcgcgggtgactgttccgaaagctgctgtagttttacctttcccgttaccggtaaacacgatcaaaataccgcgaacttcctgtgctgcagcaatccgtgaatctaccttttcttttaatcgttgttggcgctgctggtggcgatcttcagacataatgattacgttccttttattcagctggaccaggtttacggccgggctgtgcatcgaagctgatccccgtttttctacggctgtcatcgcccatcaaatagaggtacaacggcataatatctgctggcgttttcaacttgctcgcatcttcatcggggaatgcggtcgcccgcatttgtgttcgggttcctccaggattgatgcagttaacccgcaggttgctctgtttatactcctcggccagtacttgcatcatgccttccgtggcaaattttgagaccgaataagctccccagcctgcacgtccctgacggccaacgctggaactggtgaacaccagagaggcgctaggggatttcagtaataatggcagtaatgcttgagttagcataaatgttgcattgacattcacttgcatgacgtcttgccagacggcgatgctttgctcggacatgggggcaacttcacccaataaaccggcgttatgtaagacgccatccagcctagggacctgtgcacttacggtgtcagcaagttgctgacaatccgcggcggtggcatgcaatagatccagtgacagcactaacgctggcaaaccgcccgcatcagctatctgcttttttaccgcgagcaatttactttcggtgcggcccactaatatcaggcgagcaccaaaccgagcgtaagtcagggccgcttcacgaccaataccatcacctgcgccagtcacgagaataatgcgctgattgagtaggtcatgtttaggttgataatgcataattattcctcttgctggcggagtgaactcttcccgtccataccgtgtgatctttctcattcttatatttaagtgaaaccaatgcaatttttcatttacgggagacgccagctcagtggttcgctagaatgcaggtatctctctaaaaacacatgaagaaaggcggtatttgtggagttaatttctttgtacgggctgtttctggctaaagtggtgaccatcgtggttgcgattggtgcagtagtgttattggtggtcagccagggaatgagaagacaagggcaacggggggaattgaacctggttgatctgggggaacaatataaagaaactcagcgagaaatgcggctggcacgcatgagccatgcagaacaaaaagcctgggttaaagaatttaaaaagcaggaaaaagcggatcaaaaactgaagaaacaacgcgcaaaatcgggtgcggtggcggcagtaaaaccatgtttatatgtcattgattttaaagggagcattggggcgcaggaggtctcttcattacgtgaagagatctctgctattttggccgttgcaaccgcgcaagatgaagtgttgctacggctggaaagtccgggcggtgtggtgcatggctatgggttggcggcttctcaattagcgcgcctgcgtcagcgtgggatccgcctgacggttgcggttgataaagttgccgccagtggcggttatatgatggcctgtgttgctgaccgcattatctgtgcgcctttcgccattattggctccattggcgtggtcgctcaaattccgaatttccatcgcttactgaaaaagaacgacattgacgtagaactgcataccgcaggtgaatttaaacgcacactgacgttgtttggtgagaatacggagcaggggcgtgaaaaattccgtgaagatttaaatgaaactcacctgttatttaaacaattcgtgcagcagcaacgtccttctttagatattgatgctgtcgcgacgggcgagcattggtttggtacgcaagccaaagagaaaggtttggttgatgctatcggcaccagtgatgatttactgatcgctgaaatggataatcacgaagtcattggcgtgcgttattctcatcgtaaacgcctaatagagcgttttatggggagtgcaaccgaaagtgttgacagcctattattacgttggtggcagcggggtgagaagccgctgctataacccatagtagcttcttagtgatggcaataaatgcagggggtaatctgaacggtaccccctgctatttgctaccaacccagccgttaactggctgtgataacaagaaaatattctgatactaatcaattaaatggtacttggcggataatacgtgagccagatgtttgaacatattaaatacagcggttgttttcgctgttggtaagccctcagcatcaaggaaatattccccgcgaaatactaatacagggcctttctgctcaacgtctgttgcgtgcataccgtgcagataatcctcatgttgacgaataatttcattggcctctgctaataatttactacgttcaataggggttgtgtttacgtgcattatttttcctcactacagtgcaattttgccgtctattgtacttcgggttagcatttgtccgcaaaccgactaaggtttattcgagtatttggatgctctataacgactattggataaattcatattccgagctaattaggttgcgtggcgtattttatcaggtacagtgtgggattttatactatcaagtggaaggttttgttgacgccattaggcaaaatcacagcttaaactttgagcacagacaagaagttgcgggtttttcaagcaagactcgaaatgtacagttttgtgttccgatcaaaaaacaggttgatatcctaaaaaagtaccgcaatataaaaaagagattcagaatgctgcggcacagcaagataaaaaccttcttttagaagaaataatttaggtaaaggtaattatgggtaaagctctcgtaatagttgagtccccggcaaaagccaaaactattaataaatacttagggaatgattacgtggttaagtccagcgtcggtcacattcgtgatttgccgaccagtggctcagccagtaaaaagagcgctaactcagctgaagaaaaagccaaaaaagacgataaacccaaaaagaaagtgaagaaagacgaaaaggttgccttagtcaaccgtatgggggtcgatccttatcatggctggaaagcgcagtatgaaattttgcctggcaaagagaaagtggttgccgagctgaaagcattagcagaaaacgcggatcatatctatctcgcaaccgaccttgatcgcgaaggtgaggctattgcctggcatttgcgggaagtgatcggtggggacgataaacgttttagccgcgttgtctttaacgaaatcaccaagaatgcgattcagcaggcgtttaatcagcctggtgaactgaacatcagccgtgtaaatgcacaacaagcccggcgttttatggatcgggttgttggctatatggtctctccactgttgtggaagaaaattgcccgtggcctgtcagctggccgtgtacagtcagttgctgtgcgccttgtggttgaacgtgaaaaagagattaaagcattcgttcctgaagaatattgggagctacatgcagatttagtggctaaaggtgacattccgattcaaatggaagtcactcatgcccatggcaagccatttaaaccggtaaatcgtgagcaaacacatgcagcgctgacgttactggaaaatgcccgttataaggtgttggatcgtgaagataaaccgaccagcagtaagcccagcgcacccttcattacctccaccttacagcaggcggcaagtacccgtctgagttttggtgtgaaaaaaaccatgatgatggcacagcgcctgtatgaagcgggtcatatcacctacatgcgtaccgactcgactaatttgagtcaggatgcattgacgatggtacgtggttatatcggcgataattttggtgataagtatctgcctgcaacgcctaaccaatacagcagcaaagagaattcgcaggaagcgcatgaggccatccgcccttcagatgtcaatgtgttagctgagcagttgaaagatatggaagcggatgcccagaggttgtaccaattgatttggcgtcagtttgtggcgtgccagatgcctccggccaagtatgactcgaccacactgacagtgcaggcgggggatttccaactgcgcgccaaaggccgcacattgcgctttgatggttggaccaaggttatgcctgcgctgcgtaaaggtgatgaagatcgcaccttgccggtgattgaagtgggcagtgatttagacttacaaaaactgattccgagccagcattttaccaagccaccggctcgttatagtgaagcatcattagtgaaagagctggaaaaacggggtattggccgtccatcgacttatgcctctattatttcgaccattcaagatcgtggctatgtgcgggtagaaaaccgtcgcttctacgcagagaaaatgggtgaaattgtgacagaccgcttggaagaaaacttccgcgagctgatgaattacgatttcacggcacgaatggaaagcggtttggatcaagtcgccaatgatcaggccgaatggaaaacggtgctggatggcttctttgctgaattcagcgagcagcttgaaaaggcagaaaaagatcctgaagaaggaggaatgcgcccgaatcagatggtgatgaccagcattgattgcccaacctgtggccgtcagatggggatccgtactgcgagtactggggtgttccttggctgttccggttatgcattgccgcctaaagagcgctgcaaaaccaccattaacttggtgccggacgctgagattttgaatattctggagggtgatgatgcggagactaacgcattacgtgcccgccgccgttgccagaaatgtggtactgcgatggatagctaccttatcgataatcaacgcaagttacatgtttgcgggaataacccagcgtgtgatggctatgaaatcgaagcaggtgagttccggataaaaggctatgaaggcccaattgttgagtgcgagaaatgtggttctgaaatgcacctgaaaatggggcgcttcggtaagtacatgggctgcaccaatgacgagtgtaagaatacccgcaagattctgcgtagcggtgaagttgcaccaccgaaagaagatccggtaccattgccagagttgccttgcgagaaatcagatgcttatttcgtcctacgagatggcgcagctggcgtgttcttggcagccaatacattccctaaatcgcgtgaaacccgtgcgccgctggtagaagaattggttcgctttaaagaccgtttgcctgagaagttgcgttatctggctgatgcccctgtggttgataaagagggtaataaaaccctggtccgtttcagccgtaaaacgaagcaacagtatgtttcatcagagaaagatggcaaagcaacaggctggtctgctttctatattgatggtaaatgggttgaggcaaagaaataaattcaacctaaagcgaatacttaggctcgttgtagtctattgcttctgacctcggtaaagccagccttcgcggctggttttttattgggctaatttatccaagtgctttatagtcttaggtaatttctctagattatcactctcgagtcgttacctgcatttgttaaaacccgctattattttttgtgtacatgttctatacagtcgctgatgaaatgatataatcgttatataagatatttttttataacctggcgttattataaggtcatgctgaccaacctggcatcatgcagtttatagggttcaggtaataacttttcggcataccggtgcgataccgatataccaaactgtggatttccccgcagttattcaacctaggatggtatagatatgaaattgcagcagcttcgctatattgttgaggttgttaaccataaccttaatgtgtcctctacggcagaaggcctgtacacctcgcaaccggggatcagcaaacaggtaagaatgctggaagatgagttaggtatccagatttttgcccgtagcggtaaacatctcacgcaggtaacccccgcagggctggaaatcatccgtattgcccgtgaagtcttgtcgaaagtggatgccattaaagctgttgctggtgaacatacctatccggataaaggttcattgtatgtggcgaccacccatacacaggcacgttacgctttacctaatgttattaaaggttttattgagcgttatcctcgagtgtctctgcatatgcatcaaggatctcccacgcaaattgccgaggcagtctctaaggggaatgccgatttcgctatcgccaccgaagcattacatctttatgacgaccttatcatgttaccgtgctatcactggaaccgggcagtagttgtaaaacctgatcatccattagcaggtaaaacgcatgtcagtattgaagagctggcagcctatcctatcgtcacttatacctttggttttacggggcgctccgagctagataccgctttcaatcgcgcaggccttacgccgcgtattgtgtttactgcgaccgatgcagatgtgattaaaacttatgtacggttaggtttaggggtaggggttatcgccagtatggcggttgatccggttcaagatcctgatttggtgacagttgatgccagagatatctttacctacagcacgaccaagattggtttccgtcgtagtacgttcctgcggagttatatgtatgactttatcctgcgttttgccccacatttaactcgtgatgtggtcgataaggcggttgccttgcgctctaatgaggatatagaggccatgtttaatgatattaaattgccagtgaaatgatttagtagcaatttattattgttagctgaagaggccgagtgctcacgagtgtataaattgcgtgtgagttataaataacccacgcttcaccgtgagcttaaagctcgatagcagaggaggagcatcttgaatcctctgctttatattgatattacggtattctcccctatcttatttttcgtaaatctatcttatgatggtcggtgcctgctagtttaaggtgtgatcagttttatttactgattaatcggtaaaaattgaaagttattacaattttttaggtctattatttcactccgcattaaatagaagtattaattataaatggagctgatatgtttcctcacctcactgattttgtatcactcagtatccttacaccgattaaaaatgatgctaaagaaactcctgttgaaccaaatgatataattattattgttaataatgccgataaggaggaaaacaatccacaatatgtggtactggataatggaattagacaagcaatgatagataaaaccacaaatcactatgataaagagtcacttactcacttggctagtacctatccacttgttgagatcggtgtgcgtgataggttacaggaaataaaatcaccactgcagtttccctattctgtggatattaatgtagaagataaatcagaaaatggggtagtgattcatcaacatattgtttatgcatatagttctggaggccatggtagtacaagcagtccagatcagaattgtactcaagtgaataaaccactcattgacatttattgccagattgatgtgccaggggataataatttattacacagcctagatatcaagttgtctataaaactcaatgaagaaattggcttctctttaaataaaatatttaacccttatgatattctacgcaatatatgggggaatgtcataaaactatatgaagagaataaaattgataataacattaccgattcagatatgaattttgatgatgacgaatgggtaagtgatgaagatattgccctgttggaggagttttctaagcaaaaaaataatattgaagagccacataaaaaactagagttggtatatccagagaatcaagagcttgagtgggatgatgattttgacctgctccccattgattatttcaaatcagatgccgaggagtatgatctctccttacattaacaatataagtataaaaatattccaagggtgctaaacatagcctcgttataattaccgtagcttatcgtcatcttaggtgatacctatcactatgaacgctcaccattgttattaaaatgttaacatttctttgtgttatatttaagctagacctcataacattatggttataggccctaaataattcgagtatcaggaaggcggcaactgagtcagtcccaggagcttacaccagtaagtgattggggtgaacgaagacagccaacgtacatgcaacttgaaatataacgggtataaacccttgcagagagatagacagataacacattgaattaaacatttataagaaacaatggaggcactatgtcgttggatctgtgtaaaacgagcatggccaagttggtcgcccttaaccacgagtatgactactacagcctgccgcaattggcggcagtgttgggtgatatcaaccggttacctaaatcgttgaaagtgctgcttgagaacttactacgccacttggatggggtgcaagttcaggaagcggatttaaaagccattgtcgcctggcagcaaaccgggcatgccgatagagaaattgcctaccgtcctgccagggtattaatgcaagattttacgggtgtgcccgcagtggtggatctggctgccatgcgtgaggcagtccaacggctaggcggtgatgtggcacaagttaacccgttgtcacctgtggatttggttatcgaccattccgtgacggtggatgagtttggcgataaatcagcgtttggtgaaaacgtacgcttagagatggaacgtaaccacgaacgttatatctttttacgctgggggcaaaaagcatttagccgttttcgcgtagtcccaccaggaacgggtatttgtcatcaggttaatcttgaatatctgggacaaaccgtttggcatgaacagcaaggtgataagcaggttgcctatccggatacgttggttggcacggactcccataccaccatgatcaatggcttggggatactcggctggggcgttggtggtatcgaagctgaggctgccatgttaggtcagcccatatcaatgcttatccctgatgtcgtcgggtttaaaatgaccggtaaaatgcgcgaggggatcacggcgactgacctggtattgacggtcacacaaatgctacgtaagcacggagtcgttggtaagtttgtcgagttctacggtgatgggttagctgatttaccattggccgatcgcgcgaccattgccaacatgtctcctgagtttggtgcgacctgcggtttcttccccgtagatgaggtgaccctgaattatatgcgccttagtggccgcagcaatgagcaaatagcgctagttgaaacctacagtaaagcacaggggttatggcgttatcccggtgatgagccggtctttaccagtcaattatctctggacctaagttcggtagaacccagtctggcagggccaaaacgcccacaagacagggtcgcattacctaaagtgccatcggcatttaaagcgtttgaggaactggagttcaacaataagagagataaagctgacctcgttgctttctctcttaatggcaaaacccacgaactggcatctggcgcggtggtgattgcagccattacatcttgtacaaacacgtcaaaccccagtgtattaatggcggctggattattggcaaaaaaagcgactgaaaaagggttgaaaaccaagccatgggtaaaaacctcgttggcgccaggttctaaagtggtgaccgagtatcttaattcggccggtctaacccgctatctggataatctgggtttcaatttagtcggctatggctgtacgacttgtattggtaactcggggccattgcctgagccaatagaaaacgccatcaaagcaggggatttaacagtcagtgcggtgctctccggtaaccgtaattttgaaggtcgcatccatccgctggtcaaaaccaactggttggcatctccgccactggtggtcgcttatgcgctggcggggaatatgaatatcgatttaactcaggatgcgctgggtcatgacccttcaggtaagccggttttcctgaaagacatctggcctaccgggcttgagatcgccaaagctgtcgaggaagttaaaacggagatgtttcgcaaggagtatgctgaagtctttaatggcgatgaaaactggcaagccattcaaatagaaagtactcctacttacgcgtggcagaaagattccacttatattcgcctccctcctttcttcacggatatgaaggcagtgccggatcccgtgcaagatattcatgatgcgcgcattctggcaattttggctgactcggtgacgactgaccatatttcgccagcgggcaacatcaagctcgacagccctgcgggccgttatcttcgtgatcacggtgtggaaattaaagagttcaactcttatggttcccgtaggggtaaccataaagtgatgatgcgcggaacgtttgctaatattcgtattcgaaatgaaatggtccccggtattgaagggggcataacgcgtcatattccatcgcaaaatgagatgcctatctatgatgcagctatgcgttatcaacaagaaaacgtgcctctggcggtgatcgccggtaaagagtatggctcaggatccagccgtgattgggctgcgaaagggccacgtttactcggtgttagggttgttatcgctgaatcatttgaacgtattcaccgctcaaatctaattggaatggggattttacccttagagtttccacagggggttgatcgtaaaacattagggctgactggtgatgaatctatcagtgtcagtgggctacaaaatcttgctccagggcaaatggtgccagtgacgataacttatgcggatgggcatcagcaagtggtcaatacccggtgccgtatcgatacagggaacgaactgatttattttgagaatggtggaattttgcactatgtgatccgcaaaatgctgtagtgactggggggaatccttgctagttatataaggtcactgttagctagaggcttgagcgacaaaagtgtcatttggattgagccaccgaggttatcagcctctaaagggtaggtataattattgaacctacccttattcttatttcgcgactcacccgtactgattatttggtgagtaaatgccccattttggccgctttggttgccagataatgttcgttttttgggttttcgcccacgatcagtggcacacgttcgacgatattgatccccgcttgggtgaggatctcgacctttttagggttgttggtcagcagacgaaccgctttgatgcctaataatttatacatatcagaacagagtgtgaaatcacgttcatccgcagcaaaaccaagctgatgattggcttctaccgtatcagcccctaaatcctgcaatgcataagcacgaattttattcagcaagccaatattacggccctcctgacgatgataaatcagcacaccacggccttcttccgcgatacgcgtcagtgcaacctctaactgaaaaccacagtcacaacgcaggctaaataaagcatcaccagtcaggcattcagaatgtacacgggacagaaccggtttatcaccggagatatcaccgaatatcaaggccaggtggtcatgcccggtggccaattcttcaaaaccgaccattaaaaagtcaccccaaggagtgggtaactttgcttctgctacacgttttagctgcatatcattgttcatattatgacttaggctcttagagtatgttgtggcgcatcctactgccggatgtccgttttaaccagatatagacctttctacttggagagttgcagtgcagtgagtggcgataccactgacgtaaatcagcgcatagtggctcgctcaaatactgtctaatggccactgcaattacttaggtatatagggttaaataaaaaaatttccgtgataactattggctatattgccataagttttagtcggctgctgttcaacaaagcagcgatagataaagagggaaatacattgtatgcctatattttgttaaccagaaaaatttatgtatcttatcaattgactagcattacttatattatttagctattacatcaaggtaatctgtaatggcaagcgaagtagtatagatttgtctggtgtgataaacaaatgctgacttaatgtgagtttattattttctcaatagcacgaaaaagaaagaaaagggcccctgatgtataacatggcaaaacgagtcactatcggaacggttattttattattgccaacgttagcgatatggctttccgattggcagtggcaaccagggggaaataacacgtggttaaaaggttttttttgggtgacagaaacggtaactgcaccttggggcatactgaccagtgtgttgctttgtagttggttcttgtggtgcttgcgggttcgctttaagcctgccgttgggctgtttgtggtattaggcgcggtgattgttctcgggcaaggtgtaaaatcgttgattaaagagcaggtacaggaacctcggccatttgttgcctggcttgaagccgagcatcatattaataatcgccttttctattctttaccgcgtgccgaacgcagtgagttagtcaggcagcagttacaagaccaattgattattcctgtgtggttgagccgtcactggcagtttgagaccgggttctctttcccgtcaggacatactgtatttgccgccacttgggcattattagccgttgggctgctatggccacggcgacattataaaacggtcgttttactgatgttatgggcacaaggtgtgatggcgagccgcttatttttaggtatgcactggccgcaggacctgattgccgcgacgctcatcagtggcgtcttggccgctgtggcgtgtggactcctccagcatgggttcggccttctggatatcccgcaatcagaacaaaaagagagcgaaaaacgggggcatgagtaaagcgaagcaatagggtattatgcagggtcagtgacgtaaaatagtgctgatcaaggaagagcttggtgctttatcttagtgcagggtttctttgcagggtaaggaagtgctaatttattgggtaaggacgccacatttttggcataattcatcaggttgattcggcctttgggaaaaaacgtgaaatatttgctgatttttttattagtactggtggttttcgtgatttcagtcacgttaggggccaataacgaccaactcgtcgcctttaactatttactcgctcaaggtgaatatcagctgtctacgctattggcaacgctttttgcggccgggctggtgctaggctgggtcatttgtgggcttttttatctgcgggtacggatctctttgggccgcgcagagcggaaaattaaacgtattgaaactcagcttgaacagcctgttgagcaaagcacgcttgtgtccacagctgctgtcaacaaggaataattttctatgttagaaatgctgtttctgctgttgcccgttgctgccgcctatggttggtatatggggcgcagaagcgctcagcaggataagcaacaggatgctaaccgcttgtcacgtgaatacgtggctggggttaacttccttctctcgaaccagcaagataaagcagtcgatctcttcctcgaaatgttgaaagaagacagttctacggtcgaggctcatcttactctgggtaatctgttccgctcacgcggcgaagttgatcgcgccattcgcatccatcaagccttgatggagagtgcatccctgacatttgaacaacggctattggctgttcagcaactcggtcgggattacatggccgcaggtttatatgatcgggcagaagatatgttcaaccaattggttgaagagcaagattttcggctcggcgcattacaacaattactgataattcatcaggcaaccagtgattggcataatgctattgaagttgcggaaaaattggtcaagatgggcaaagataatcagcgtctggaaattgcgcacttctattgtgaacttgcgttgcaagcaatgggcagtgacgatctggataaggccatggggttactgaaaaaagcggcaacggcggataaacaatgtgcccgagtttctattatgcgtggccgtgtgcatctcgctaaaggtgagtatgccaaaggcgttgaagcgttggagcgagtactggagcaagataaagaagtcgtcagtgaagcattaccgatgctcagtgaatgctaccaacacctgcaacagccccaggcttgggctaatttccttaaacgttgtgtggaagataataccggtgcggcggctgaactgatgttggcggaggtccttgaacagcaggagggccatgatgtcgcgcaaacgtatattaaccgccaattacagcgccacccaacgatgcgcggtttttatcgtctaatggattaccacttagcagatgcagaagaagggcgtgcaaaagagagtttattgctattacgggacatggttggtgagcaaattcggaccaaaccacgttaccgttgtcataagtgtggtttcaccgcccactcactctattggcattgcccgtcttgccgtgcctgggcatcagttaagccgatcagaggattagatgggcagtaggggggaatagtcagattaaaggggagtgatgttctttgctaataaggatgttctttgctaataaaatcgggtgaacgggtccacccggttgttagctgttgtgatgaagcactttggcagtttattttttcttttgagcggttttcgcactgtctttcagcagttgacgcagtttttttaattctttctggcttagcggctgttctgaaatctcttctacaccttgattgtcgatttcatcgtgatgcaacttggcattcttactactgcttatactccccttaatatcagcctcaaagctttgcgctaatctttcgcagacttcagtgctgagagaaaactgcttttctaatgctgcagctttgattttttcttttaattccagaggaattttaatggttaaggtagatatctcactcatcatataaccttcaatttagggaaaataccaagctaagcgaggaaagggcaactgtccagggaataacataaatatcacaaaaaattcataatgaggcatgaagaaacgcgctaaaagttggcggtatgacgtaaataggaccggtacagcgtcatcatttatgttatggaaacagaattaattttgctttgattaatttttttggcattttttgaatttttagataacgcttaggagaaaagaaataagttggaagattagatgaaactatttgcgtgggttaaaaaatggcaacggcttattgtcttaataataggaaataggggtgtggacgataaggtgggatagatgctacctgccgcagcatgacaaatggagaatcaacacccgccggatcactgtaatttcagtgatacaccctgtagaatatgagcgttatcatcaattattgactgaagaaggctgaagaatgacgtccgcaactaaaactaataacagtggctcaatatcctccccaattgttgttgcgttggattatgccaataaagacgctgcgttagcctttgctgatcaggttagtccacaggattgccggttaaaagtgggcaaagagatgtttacgctgtacggccccgagcttatccgtgacttacatcagcgcggctttgacgtatttcttgatttgaaattccatgacatccctaatactaccgcgcgtgccgtggctgcggcagcagagttgggggtctggatggtcaatgttcatgccagtggcggtgcccgcatgatgtcggcggcgaaagaagccttattgccttatggtgcacaagcccccttactgattgccgttactgtactgaccagcatggatagcgaagatctgcgggatatcggtattactatcagtccggctgagcaggccgagcggttagcgaaactgacctgggattgcggtttggatggcgtggtgtgctcggctcatgaagcggtgcgtttgaagcaagtttgtggcgaagacttctcgctcgttaccccaggtattcgcccacaaggcagtgaagccggtgaccagcggcggatcatgacacctgaacaggcggtagctgtaggtgttgattacatggtaatcggtcgcccaattacacaatctcctgatccggaaaaaacgctgcgcgaaatattggcatcactgacgaaggtggcataatgagcaatgataatagtcggttagtttattcgactgacagtggccggatcagcgaaccagagagcaaagttgagcggccaaagggggatggcattgtccgtatacagcgtcaaactagcggccgtaaaggtaaaggtgttagccttataacaggcattgacggcagtgatgaggatctggataagctagccgctgagttgaaaaagaaatgcggctgcggtggttcggtcaaagacggtgttattgaaattcagggcgacaagcgggatttattgaaacaactgttagacgctaaagggatgaaagttaaattggcaggggggtgatttaataaaatccttttttccgcgcagatataaaatacggcgttgatattgtcaaacgccgtattttatttagaacttctaatgccgtggcaatataaactcgaaagggttaatcaacatcattaacgcggcaacaaggcagtaaacaaacgattactgctaatcacgctgcagcgtcaagtaccattctcaacgccaagtaccattctcaacgttaagtagcatttgcaacgttaagtacaaatagggggggcgttatttaccaacctgatggccgataaccccaccgattgccgcaccgcccaaggtgcccaatgtactgcctgtcaataccgcaccacctaccgcgcctgcgccagcaccaattgctgtattccgatcccgtttggacatattggaacaagcggagagtgacaaggctagcgttaacgccaatgcggcggtagcaaatcgtttattgataatcatcataatagttctcctgacgttagctcagaacggatagtgcaggcgatagcaagagaaaatcatgctatatgtcctgatatatccgtgccacgttgaaattataaccctaagtataggcattatttcaatgttagctgctgcgtcgctcattttgttaatggtttgaataaaaaatcgtcatttatattttagattaatactgggaacggttttttcacggataaaatcagtataaatatctacaaattatttagtatgtgaataatcctaatttggcgctaaaaagtaaaacactgccattttcagggactaatagcacgattgattcattatcaggttaaataaacggcacccactaatatccggatctctcagtgcaggatttccagccgatttgtacgcagtttttagctatttaccccataccggttatttcctgcggcgctgaaaatggaacaaattcagttattcaggatacgacgatgctcaacgaactgaagcagcaagttcttgccgctaatcttgctctaccacgccataatctggtgacattcacttggggtaatgttagtgctatcgatcgccaaaagggtttactggtgattaagccttcaggtgtggaatatgcgtccatgacactggatgatatggtggtcgtggagttggagagcggcaacgtcgttgagggcagcaaaaaaccatcatcagacacggatactcaccgcgtgctgtatcttaatttcccccaaattgggggcatagtgcatacccactcccgtcatgcaactatttgggcgcaggcggggctagacttgcctgcttgggggacaacccatgctgattacttctatggatccatcccctgtacccgtttgatgacacatgaagaaattgcgggtcgttatgaatgggaaaccggtaatgtcatcgttgatactttccatgaaaggggcatcaccccagatgctgtacctgcggtgttggtgaactctcatgggccatttgcctggggtagcagtgcggagaatgcagtacacaatgcggtagtcttggaagagttagcgtatatgggcattttctcgcgtcaattgaacccgcagttgggcgatatgcaaccgcaactgctggataagcattacttacgtaaacatggcaaggatgcgtactacggccaataaaggcaaaacataaataatgagcccgtgttcagtcttgcacgggtttttccagccagagcagcgaatcggtaacatcaagcattttggcttcaatctgtgcaatagcgtcattgatgccttggttatagtaatgcgcacctaactcacggctaataaattccacgaaaaattccgcatcaaaatcctctaattcaatattgtgttcttgctccagatagcgctgaattttatggaccattcgttgagtctgttcacgagtgaacgtgatatctgccatgtttattgctccgatatgtttattgaactgaggatcgcttgcgcatggggtccgggttaattactgagtcaatttttacgcataatacgctaaataaagaagataacagcctgtatttataagataaaaatgacggcgagtacacaacctcttttactgctctcatgatttgagccgagtagaaaataaaaaaactttcgtgtgaagcctatgttattttcgaataagaatattttgataagaataacgttatcgattctttattcgtctatgattgcggcttatggtttttcatcaatacgttcacttaactatcctgacccagaggcttttatggaactttatctcgacacggcagatgttgcggcggtaaaacgattagcgcgggtgctgcctttgcagggtgtaaccactaacccaagtattttggcaaaagcgggcaaatccctatgggaggttttgcctgcgctacgtgacgcactgggagggacggggaagttatttgcccaagtgctggccagtgatagcgaacgtatggtctctgaggcggtacagctgtcagagcagatccctggattagtgattaaaatccctgtcacggccgaagggttggcggcgatcaaaaaattgaagacgatgtcaattccaaccttgggtaccgcggtatacggcgcagggcaagggctattatccgtgttggcgggagcggaatatgtcgcaccgtatgtcaatcgactggatgcgcaagggagtgatgggattgctatggtacgtgagttgcagcagttactcacgttacatgccccaaacgctaaagtgttggcggccagttttcgtacacctcgccaagtactggattgtttgctggccggttgccaatcggtcactatcccggtcgatgtggcagagcagtttatcagtacgcctgcggtaaaagcggcgatagaacaatttgagcaagattggcagggggcatttgggacgacgatgttgagttagcttaaggtgataaaagataagaagttacagacagtaacaatgagcggtaaaagaataacgccctataaaatcactatagggcgttacggtgtcactaatttatgtctattgccactctagcacgggcatttccccagttttcccccttcgctggggaagcgggcatccaggcaataacgatggaactcccgctcagtcattgggggggtgtcaggatgcttatggcgcatatgattgacataattactgtaatcctgcaccccaaccatcagcctgaagctttgcgccagccgatgtgtaatcagccgtacccatgcccacagcgtggttggggctgcttcgacctgagtaagtggcacgcagcgagtaatcttccccccggttattggccgggagcggtacggaataccagagttaaccacgggcgacctcctcacggtatacaatttcagtttcatgggttgttggtttgctggatttcagtgcgcgacgaatcacaaagaaggcagaaactagcatcgtcaccgccaccagcataaagaatgcacatagcgcggcgttgatctggttgctaaacacgatagtttccatgtctttaaagctcttcgcgggtgcgattaacaccccttgttcaatgccgttagagaatttttttgcttgagcaaggaagccaatacttggtttttcatggaatatcttctgccaacctgcggtcattgaggtgataaataaccaaattgttggcaggatggtgacccaggcgtagcgttgtttcttcattttaaacagtacgacggtacctagaatcagtgccattgatgccagcatttggttaccaataccgaacagcggccacaaggtgtttattccccccagtggatcgataacaccttggtaaacgaagaatccccaaccggctaccgcgactgtcgttccggaaaggttaccaaaccatgaacggttattggccagacgaggtacgaccaccccaaccagatcctgaaccataaagcggcaggcacgggtaccagcatcgaccgcagtcagaataaacatggcttcaaacaagatggcaaagtgataccagaaagccatcatattacggctattaaatatttcactgatgatatgcgccatgcccacagcgaaggtcggtgcaccaccagcccgtgacagaatcgagttttcaccaacatctttggcgaccatcgccagtgtttctggcgtaacgacaaacccccagctactaatggccagcgaggcactttctacggtggtaccaatcagagccgcgggtgagttcatggcgaaataaacaccagggtcgataaccgaggcacagattagcgccatgatggcaacgaatgactccatcaacattgcgccgtagccgataaagcgggtatggctttcgcgttcaatcagtttcggtgtggtgccactggataccagagcatggaagccagagatagcaccacaagcgatagtaataaacaggaacgggaacaggctgccggagaagaccgggccgctgccatcaataaagtgtgagaccgcgggcatcttcatttctggcatggcgaatacaataccaaccgctaaaccaatgatgaccccaattttcaggaaggttgataagtaatctcgtggtgctagcagcaaccacactggcagtacagaggcgatgaaaccatagataaccaatatccaggttagcgtggtgccatgtaacgtaaagaaaggcccccagtaagggtgtaccgcgatgttcccaccgtaaatgattgcagacatcatcagtacgaaaccgattaatgatacttcagcaattttaccagggcggataaaccgcatatagacgcccataaagagggctatggggatcgttgcggcaatggtaaacaggccccacgggctatcagctaatgcttttaccaccaccagtgcgagtgcggacaaaatgataatcattacgcccaatgcacccagcatagttatcacaccagcaaatgcccccaactcttgctttgccatttcacccagtgagcggccatcgcggcgagtggagataaacaggattaagaagtcctgtacggcaccggccatcattacaccgaccaggatccagatagtccccggcagaaaacccatctgtgcggccaagattggcccgaccagtggcccagcacccgcgatggcagcaaagtggtgaccaaacaacacccatttgttggtaggaacataatccagaccgtcattgcgtcgttctgctggcgtcagacgacggtcatccagttcaaagacattcttggcaataaaccgactgtagaagcgataagcgatgctgtaacaagccacggatgcaatcactaaccagatggcattgacatgttcaccccggctaagggccaacatggcaaaggcaaatgcaccgattagcgccactgtcagccatatgacaacggtcctgatgttattcatgggtaacgactccttcgcaatgtatgaggttttactgttatcaacgccgttcagaggtaagagagcgcgtaacggttacttaacataggagctttgatgtgaaagaaaagtagcgaaagtgagaagtgtgatgagttaattgtttttaagtcacttttcgtattatttgcttacatgttgtgatgagggatacaaatggcgagtattgatgggtaagctcggtcaatgagtagggcaataggtaccgctaacacagcagcgacgttaagcaagaagggcggcaaacataacattaaaaaagccgtcgggggaattcctccgacggctatcatgttaaaacataagaaaattaagctactgggcgagcaatgacattacgggtttccatgcgaacttccgcaatacgtacctcgattttgtcactttggctataaactgtttcgcctttgatctgcacagtaccggtttcctggctgcagaccacttcatcacgcaccgcgtgaataaacggcgcaggaataaaggcaacggcaccgttatccagtaaacgcacacgcaagccaccgcgggtgatatcaataatctctgccgtgaagcgagtgtcagttcctgcttgtggttgcagataacgggcatacaaccaatcaccgacatcacgttcagccatgcgattcaggcggcgacgttcagccaattggaccgtgatctcttcttgtggtttttctgcttgttgaccagtaatcatcgctttcagcaggcgatgattgaccatgtcgccgtatttacggattggagatgtccaggtggcataggcttcaagccccaagccaaaatgcggaccggggacagtactaatttcagcaaatgtctggaaacggcgaatacggctgtcgaggaactgtgttggcagggcatcaaggtgacggcgtaactcacagaaaccgggtaacgtcagcagggcttgaggatcggcatcaacaccattggctttcaatacgctagccgcttgttcgactaatgccgggtcaaaaccggtatgcacgttataaataccaaaaccgaggtgttcccgtaacgccaatgccgcacagacgttcgccgcaatcatacactcttctacaatgcggttggcgatacgacgatgctcaacaatgatatccagcacttcgcctttttcacccaacaggaagcgatagtctgggcggtctttaaagaccagcgcatgttgttgacgccagttgctacgggcgtcacagatacgtttcagtaacgtaatctgctctgcaatagcggtatcttgtggctgccagcgattatttccttccaaccagtcagagacatcgtcgtaaaccagtttggcttttgattcaacccaagcagcggagaaacgaatatcgttacttagcgtcccttcttctgtgatcgtcacacggcaaaccaatactgggcgacgttcatttgggcgcagtgaacagaggttgtcggacaaatcacgcggaagcatcgggatgttaaaacccggcagataattggtaaaagcacgcttacgggcggttaaatccaattcactgttttcgacgacgtaagctgttgggtctgcaatggcaatggtcaataaccatgaaccgtcgccattgtcttggacaaacagcgcatcatccatgtcttcagtgctggcgctgtcgatagtgacaaaattaagtgcggttaagtcttctcgctcaagctcggcgtcatttaaggccgattcgaccatagcaggggcttcacgctcaaggttatggcgagccagtgttacccaccaaggaacgaagtggtcttcaccattggtaataaacgcggttaggtcagcctgaaaggcgcggtcgccttttaatgggtggcggcacatctcagccactacccaatcaccgttttggaagctatgcgtcagttcacgtactgggcggcattgaatagcatcacgtaataaagggtggtcgggcacgatagacagacgatcatcttttcgttgcacccggccaacaaagcgggataaaaatggctcaaccaatgtttcaggttcagcaatttcacgatccttatccgtatgcagggtggcaataatgcgatcgccgtgcatgaccttcttcatctgcggaggcggaataaagtaacttttctgcccatctacctcaagaaagccaaagcctttctcagtacctttaacgacgccttcaacgcgtggggtctgagtgtgaagttgctgttttagctgcgccagcagcgggttatcttgaaacatatcgtccagtgaatggtgtagtgagagggtttaatccggctgacagttttacgcgaatcagccccgtcgggcaagtggatatgatccggaatggcaattccttatcaaggttatgggaatgttttttacctatagcggtgatgatatcggcagatagacggtaagtggtgaataattctgtcagatgtgacattgacgtttgtcgaagccattaggctgctaagcggaaccatgccactaatccgtttaattttgccaagttacggatgctgccggcatttcatcgttcttgtttgcttgcgcctgtcagaccccccgttattttactcacatcatctcacgtctactgccgtcattctcttacttagcactctttataactagcctaaaaaaatagattgaaatcagcccgctgagttaggtcacattatcgcttgttaataaatgtgagtttaatcgcatttagttgccgaacgatcccttacttttaactttataaaacattaaataactaaaattaacatttattggttttacttaacgtcttcgttttgcttaacgccagccttcgcagtgccaggcagtgtcgccaaaccttgttccctacagtttgttccctacaaaaatagttaacaatgaggttttattatgtctgaatcatccactgaatctttgtcgcaaccgacgcagttacaagaagaaaataatgcctaccgtaaaacggtatggcatctcttgccgctactgatgttgtgttacgttctcaactacttagatcgggttaatgttggttttgccaagctccaaatggccgatgacttgcaattctcggatacggtttatggcttgggggccggtatgttctttatcggctactttttcctggaaattcccagcaacctgatactgcatcgagttggcgcaaggttgtggattgcgcggatcatgatcacttgggggattatctctgcctgtatggcatttgtgacgacgccgatgtcattttatgtgatgcgattcttactcggggtcgctgaagcaggttttttcccagggattattctttatatttcatattggtttccgtctcaccgccgtggccgcgtgtatggattattcgttatctcggtaccgttatccggcatcataggggcaccactgtccggctggatcatgcagtattttaatggttttcaaggttatgctggctggcaatggatgtttattctggaaggtattccttccgtattggtgggtattttaatcatttataaactgaaagatcgaatcacacatgccacctggctgaccgacaaagagaaagatatcttacagaccaatatagagaacgaagctgcgcatcatgcacatagccgcctgagagatgcctttttgcaaccgcgagtctggctattaacccttatttatttctgtctgatcagcggcttttatactatcggtttctggctaccgacgttgattagagacagtggggtaaaggatattttaagtattggtttcttaaccgccattccttctgcagcggcagcggtgaccatgatcgtcgtctcgcgcagtgctgaccgtttgcgggagcgacgctggcatctggcactaaccgcggtattgggtgcagtgggtattattctctcaacctattttagcgacaatatcgttgttgcgatggtgtgcttaaccattggtgccatgggggcgctgagtacgataccgctgttctggagcctgcccaccgctttccttggcggaagtgcggctgcagcaggtatcgcctttattaactcttggggcaatctgggcggatttgttgcgccttatatgatgggatacctgaaagacttgacccagagtaccacgaccggaatgttgatcatttctaccacgctatttattggtgccgcgctggtgtttttgatcccggccaaggcagttaatcattaacgactaacgactaacgactaacgactaacgactaacgactaacgactaacgacgagccaatagacaggaggagtcagtgatgaacattatgataacgggggctgccggttttctggggcgtcgattgattgacggcttactgcaacaggattatctgactgatcagcagggggagccgcgcaatatcaataaaatcattgcctatgatgtgcttcccttgatggaagtagaggatccacgggttcaggttatttgtggtgacattgccgatcagaacggactatcggcggtctgggatcgccaaattgacactattttccatttggcagcggttgtttccagccaggccgaagacgattttgatttaggtatgcgcattaacgttgatgccactcgcagcctattagaattggctcgtcagtccggccaatgccctaaagtgattattaccagttctgtggcggtattcggcggtgcattgccgaaagttgttcctgataatcaggtgtggtcaccacagagttcctatggtacgcaaaaagcattaaacgatttattgctgtctgattacagccgccgtgggtttattgatgggcgcagcctgcgtatgccaaccatcgtggtgagacccggtaaaccgaaccgcgctgcctccagttttgccagtggcattatccgggaacctctgcaagggcatgatgctatttgccccgtcagtatgcaaacgccgttatggttactctcacccaaaatggcgatcgataatttgattcatggccatgaactggatgctagccaactccgcttagggcgggtgatcaacttgccggggctatccgttagtgtacagcagatgattgatgctttgcgccgtctcgcgggtgatgaggtcgttgaacgtatccaagtgcagcgggacccttcgatcgagagaattgttaattcctggccaggtgattttgaagccagctatgggaaagcattaggttttcgtcgcgatccggattttgacagtattattcaggattttatcattgagaatttgcctgaattagcggctgagaagcactttatttagccgaatggattcaaatttggggtcagcataatcgtcgcccccaaatttgagccaggtagaatttaatccggatagaatttaaaccaagtagtttgttatctattatctctgctagccgccggacgagcctcaccaatcaaacgccataagctagatgaatagggcactaatgctctggatagactttctctttaaactcgcataagtcttcaataatgcatgaaccgcaacggggttttcgggcaatacaggtgtagcgcccatgaagaatcagccagtggtgacaatctagtttaaattcggccgggaccactttgagtagtttttcctcaacctgatcaacattgctaccaggagcaaacccggtgcggttacacacccgaaatatatgcgtatcaacggcaattgtgggccagccaaatgccgtatttaacaccacattggcggtcttacgaccgacaccgggtaacgcttccaaggccgcccgatcctctggcacctctccctgatgcttttccagtaaaatgcggcaggttttgatgacattttcagctttggtattatacaggccaatggttttgatatattcctttaagccatcaacccccagatccaagatggcttggggggtattggccacagggtacagccgggctgtcgctttgttgacactgacatctgttgcttgagccgatagcagcacagaaataagcagttcaaagggcgtcgagtaaactaattcagtcgttggatgtgggttgttatcccgcagacgggtcaaaatagtgacacgtttctctttattcataaggctttctcggcatctccatcctgaagttgcggtacgttaacccgtgtattggctttgcgcgctttcattttctcgtcaatgacatatttaccggccagcagtaaacccagaccgataaacgcacctggtggcaacatcgccagcagaaaaggggtatctaaatgcaagatgtcaatgcgcagtactgtagcccaactgcctagcaacatgtctgcgccgtcaaataaggtaccgttacccaaaatttcgcgcagtgcccctaaaacaaataaggcacaggttgctcccatccccatggcaaaaccatccaatgcggatagtcccaccggattcttcgctgcataggcctctgcccggccaatcacgatacagttggtcacaatcaatgggataaatatccccaatgattgatataaaccaaaggcataagcgttgatcagcatttgcacggtactgacgaccgacgcaataatcatgacataaataggaatacggatttcagacggtacccaacggcgcaatgcagaaactgcggtattggtacacacaaggactagcgtggtcgctaaccccagccccaatgcgttggttgccgtggaagagactgccaacaatggacagagccccaacagttgcaccagcgcagagttatttttccacaacccttgtgctaacagttttttcgcttcactcattgatcttctccacaggagggcaggcgactaagctgtggtggcagtgtttgcaaatacagtgccgcattttttactgcccgcacgacagcccgtggtgtgatggtagcaccagtaaactgatcaaacgacccgccatcttttttcaccgcccaacgcttatcgtcatcacctgttacgtgttgaccgctgaaatggttgatccaatcagagatacggatatcaattttatcccctaaacctggggtttcatgatgctcaatcacccggctgccaagaacattaccgtgaaaatctgcaccgaccaacagttgaatcgcaccggaatagccatctggtgctgtggtttcgattgcggcagctaccggttggttacctttacgcgcaaggtacaggcgatggggagccatattacccaaggctgaatcagtgacaacgtaacattctgcttgcatgtcattatcataattttctgccgggacgacttggtccagcaatgctttttgctgtaatgctgcttggtgagcaatcgtgttttcagtcagtgagttaacaaccgcagttaaccctgtggcaccggcagcaaacagcgccagagtgatgccgtgacgcctcattgtttttagcataacggctccttatttgtgcccgcttttatggccatagacccgaggttgggtatagtggtcaatcaacggaactgtaatattggcgagcaacacggcaaaagcaacaccatccggatagccgccatatacccggattagccacaccagaataccaatgagggcaccaaatatcaggcggccacggggtgttgtagaggcactgacaggatcggtagcaatgaaaaatgcacctaacatggtggcaccggagaacaaatgtagcattggtgaggcaaagctttgtggagcaatcatccagctcactgcggcacaacctcctaaggcgagcaggaagctcacgggaatatgccagtgaatagctttacgccacagtagcaataagccgccaaccagaaagccgatattaacccattgccagcctaaacccgccagcacaccgccaaatatgggctgttgcagaatttgatctgctggctgtgaacgtagcgaggtcttaaacgtatccagtggcgtcgcttggctgatgccgtcatagccaacttggagctgatgaatattctcaccactgtgggtataaccggtgaaaatggttaagagactgtcatagaatcccaccgacgttccttgcaacggtagcggtggcagccaactggtcatttgtaccggaaatgaaataaggagcacaacataaccgaccattgccgggttaaacgggttctgccctaggccaccatagagttgtttggcaatgacaatagcaaatagcgtgcccagcacgatcatccaccagggggccaatggggggaggcttatccccaacaataaggcagtcagtagggctgagttatcttgtaaccgcgccatgacgggttgtttacgtaactgcaatacggcaccttcggccaacagtgcagtgatcatagccagcatgacttgaatcaggctgccataaccgaagaagtaagtctgggcgataatccccggaatacaggccagaataaccagcagcataatacgacgggtactgcgttgattgtgggtaaaaggggaactggcaatctgcaaccctttgttctgggtcggtgttacaggcctgaatttcatgaaattgcaaccatatgtcagaatacttatcagggctttcaaacgtagggatcgcgtgggcaagtcatccttgctggcgtcaatacacgtagccgttaggggtgatattttgttgcattctaccctatccagacagagtgtaatacgtcttaattatagggttattaaccatgggggtgtagaggttattaattaaacgaaagagaacaataacgattgcttacataaaatatcacttgcaatttatatcgtcttgattacaaggaaataggcataaatgatatattaaataataaaactgacgaggtaaatatattgtaaacgtgtttgacaacggtatttccctatggctatttgcggatgaaacttaagtaactaactgtaaaataaatgattaatttatatgaagcatgagaaaaagaaaagcattggaataatgagaaattaatgtagtataaattgtaagtatatatataaagaataataaaatgatgagtgaagacatattgtttatagaagaattaatcgagtggattgaaataaatttagaaaaaaggccgacattagacgatgtggcaaagatctccggatattcaaaatggcatttacaacggaagtttaagagtatcgtcgggctacaactggcatcctatatccgtgggcgagtgttgacccgagctgcggttgcgttgcgtatatcaagaaagcctattattactatctctgatgaattgggatttgactcgcaacagacctttacacgtacctttaaaaaacggtttggcgtgacaccaaacagcttccgccagatgaaccattgggatgttcaggggatgatccctcgcttcggattctacgaaaattatacgccggaaatcaagcaggtaacgttacctggaaaggaattagtcggtttcacccggcgtctggatttcgaagagtataatggttgtgttgtgcagcgctcttcctgtatggcgatgaaagacgagatcctgcttgatttctttaaagaggtcaactttgcctgtcagcggatctactctttgttttctgttaaggatgttgatggtcaacaggggcagaagagcgtttattactcaacggcgatagacaaagagagaaagcatgagattcaagggagccgagagatcgatcacatcgcgattcctgaaggtgaatttttgtctatctcccatcaggggagcgctaaagagtgtgtaaaattcgcaacttacttgtttaacaacgtgttaccaaagttacgtgatgaagttggtcgtgggattgagatggaagtcattgagatagaccattgtcatgcagaatcgaaactgcgtgatatttccgtagtctatcgttatctgatggcagtgaattaacgcccgattagcatcatttagccattatggttatttagccagaatgattatccagccagaatgataggtaattgtggccgagcgttttcccaaactgagatgttttagtcaggatttatcgcttgagcggctttctttgctttgactctggcgatagcggcggccacagcggctttccgtgggtcttctgccatggcctctgatcccgcctccgccacgtcagtggtaacgtgttgtacctgagcggctttcttagctttgactctggcaatagcggcggctactgcggctttccgtgggtcttctgctatggcctctgatcccgcctccgccacgtcagtggtaacgtgttgtacctgagcggctttcttagctttgactctggcgatagcggcggctactgcggcttgacgaggatcaacaatgtcggttgtttcttccgttgatcgtgcctgctgtttctctgcctgccgtgctctggcctgtgcttttcgggcttcacgggcggcaataactgcactgttatccggcatttgccctgcggggatattgataacagactctgagccatcagattggcgggtcaaacgactgacagcagcgtcaactgtttgttgatcagcatcggtcaatttgacagcggcttgcttatgccgtaattctctggccaacttctcccgcgccagacgggcttgcttcgcttcaaatcgtgctttagcttcggctgcacgagcgctctcctgatcgagggcgcgtatttctgctttttcttgccggtaatattgcactagaggaatattactggggcaaacataggcgcaggcaccgcattctatacaatcgaacaaattatgattgcgggccttttcgtgttcttcaccacggctaaaccagtagagttgttgaggcaataatcctgcagggcaggcgtcaacacataaaccgcaacggatacaggattgctctggttcagataggcccatttccgtttcagcgggcgctaaaatgcagttactgattttaacgatggggacatccaaactgggcaaagtaaagcccatcaatggcccccccataatcaccattggcgggttttgaggcttgaaaccggccaatttaagtaaatacagtactggtgtgccgattctggcccaaaagtttccaggcgatgacagggcatcaccggttaatgtcaccacccgctcaatcagtggttcatcgtcgataactgcccgtttgatagccacgacagtaccgacgttttgcattaatacaccaatggatgacgaatgcttgccaaaggggacttctttgcccgtcagaatcttggttaattgcttggctccccctgatgggtacttggtggggacaacacgtaagtgaatgtcgtcttgcccacgtaatgcccgttgcagtgccgcaatcgcctctggcttattatcttctatcccaatcagtacctgctgaggctgcaacaaatgccgtaaaatatggatacccgttatgacttcatcagcatgctcttgcatcaaacgatcatcagcagtgatatagggttcgcattccgccgcgttgatgattaacgtgataatcccattcaaccccccttgcagcttgctggcagttgggaaacctgcgccccccaaaccggcaatgcctgcttggtgaatacggtcaagcagggccattttatcgcgctggcgatagtcagcccacggctgttgttcacgccagcgatcttcaccatcaggggtaatatggacgcaaagttcagctaagccggatgggtgggcggtggtatgtggagcaatcgcagtgatcatccctgaagtaggggcatgaactggaactgtacggccacggccaacggtcagtggctgccccttcaatacttgctcacccgcccgtacccgcagttcaccctccggccccaagtgctgttgcaaagggataattaattgatctggcaaaggcgcgatacgcatggggaccgtgcttgattgcagtttcatttctggtgggtggataccgccatcgaaatcccagatcttgtcatgttggcgggcagtaaacagcttaaacatgttgctccacgtctatcatttttaccggaatcatttgtgaggcgaccaactgattaggcagattcttgaccggaatggtattcaaatcccatttccagttggcggtggtggtagcaaccgggatcatttcaatacaatcggttgggcagggggcaacacacaggtcgcagccagtgcagagatcagataatacggtgtgcatagcccgtgtcgccccgatgatggcatcaaccggacaggcctgaatacatttagtacaaccgatgcagtttgcttcatcgataaacgccactttacgttgtggatgggctgcactttcatcaccatccaacggttgtggctcgaccgccaataattcggccagtttcagcatcacctgctcgccacccggcgcgcatttgttgattttttcaccaccagtagagaccgcctcggcataggggcggcaaccagggtaaccacattgcccacattggctctgtggcaaaatggcatccacttgctcgacgaccggatcttcatcaacctggaagcgacgggcggcgaagccgagcaccacgccggagaccagcgccaatgtactgagtgcgcctatggcgatccataaagacatcattagaacttcaccaaaccggtaaagcccataaaggccagagacatcagcccggcagtgattaaggcgatagaagacccacggaagggcgcagggacatccgccacagccaggcgctcacgaatagcggcaaataacaccatgaccaaagagaaacccgcagcagcactaaaaccatagaccgcggattgcatgaaattatgcgattgattcacattgagtagtgcgacccctaaaacggcacaattggtggtgatcagggggagaaagatacccagcaagcggtaaagtgtcgggctggttttgcggaccaccaactcggtgaattgcaccacgacagcgataactaaaatgaaggccagtgttcgcaaatagatcaggccgagtggcagcaaaataaagctattgaccatccaggcgcaaaccgatgccaatgtcagcacgaaagtggtcgccagacccataccaatggcggtttccagttttttagagacgcccataaacgggcacaggccaagaaacttgaccagaacaaagttatttaccaaaactgtgccgacaaataggagcaggtattcagtcattgcattgcgggacctaaaaaaataaaagccgcctattatccaaaattgacggcccgacgacaacagatgaaatgcagggttattgcgattttccctttattttagggggaaatcgtgcgcaatcacttcaacgctcggtaaaagtgtgttttacacgctgtgaacgtttgatgtaaggaacaaaaatagctgcagctagcagcggccacccgagtgtttttaatgcaatttcatcagagattggtgaaaaagcaaatgccttcaacgccagtaacaccgtaagcagtaaccacagaatgaacagcttaggaaaacgacgggaacggctacaaaatagccaaataatccacagcgtgtaaagccacatgaccagcgttgttactacggagaagtaccattgtaacgtaaaagcttgcgtgttggtcaccaaatactctctggatgccggtgtcgtgatcgccatggcgtacaagacgagcatcaggctggcgctgagcagtgttacgataagataggccagtggggctaataaccagccgccaatgcgttgatattcttgaggttgagacataataaaccttttaatctgctcattagaggtattcagtaataagatatcataccctctttctattctcctggcttaacccgcgaatgcgctcttggtcatttatatcaatatgaccataggcagcgttggctcggccatggtgttgccagtgtcaatacggacaaatccggtaacagcaaagagacgaccaccagagaataaaactcaaacgactgaccgccccaatggctcgctcttaaacggtgatttttgaacatttctttttttaactaaagcgcgttgaaaattaatagaggggtaatgcgataataaatattataaagccttagtggtgagccatattgatattttatacggtaatatgcgcatcacatttactctgattaatgtgcagaaaattgcttctacagtaatagacacctcaataacagagtacccaataatagaatgtcccaatagcagggagtctactccatggaaaatcatgttcattccgcgctgatatgtgcatccagattgattcggttggccgggttaaatccaatggatatcgagacatttagccaaaaggtcgccatagacacctcagtaaaaacaacgctagcgtctcttcagcgttatatcgttcaattttcacaaacagcttctgtccgttttaaaatacgtaagcaagcattggaaaaaataaggcaggagcagttaccgctggcatttcgtgaccgtcaggggaattttatcttgctggcgcggatgaatgaacaacaagtgttattacagtacgctgatgataaaaaaccacaaatgttaagttatcaatcacttgctgacatgtggggtggaatgatcttatgctgtagtcattcgcgctttgatattcgctggtttatcccgccactacgtcgccatcgtaagccattaatgcaagtcctattgttatcattattgctgcaattcctagcgttgatctcccctctcttttttcaagttatcatggacaaagtactcgttcatcatgcattaaccacactggaagtgctaatcttcatcttagtcattgtcggtgtgtatgaggttatattaaaaggcttgcgagaatatatttttacgcatacgacaacacgagtggatatattattaggcgggaagttgtttcaacatttaatcaggttgccgttaagttactttaaacaacgtcatgtcggtaatattgttgccagagtccgtgagttagataatatccgtgatttcatcacgggttcggccctgacattatgtgttgatgtggtttttaccttcgtgttgtttattgttatgtggtgtatatccccgttattaaccttaataatactgagcacgttgcctttttatctgttattggccgtgatgaccactcggccgttgcaaaaaaaagtggaggctctctgtggttttgctgcgcaaaacggcgcgtttttgactgaaacggtgtctggggtggaaaccgtaaaaagtttggcgctggagccacggatgcgccagcgctgggaaagccaaactcgtgattttgctcaggctaattttcaggtacaaaatttgcaaaatctcagtagccaagcggctcaactcttgcaaaaggtggctggcgcactggtgatcgtgataggtgcgtatcacgttatgtttgtacagctcagtattggtcagttgattgcatttaatatgttggcactacaggcattaatgccgatgagtaaactggttgatttatggcagcagagcatccgtgcgcaggttgggctgaaattaatatcagatattctaagcttgccggttgaaccggaggcagatccggcggccccgcaccctgcgattagcggcaatatcctactaaaaaatgtggccttccgttatcgccccgatcttgatcctgtcttacatgatttaaacttatctatccgcgcgggtgaacatatcgggttggtggggccgtcaggatcggggaaaagcaccgtggcccggttattacaacggctctataacaccgaacaaggggtcattacgatagatggttatccgatcaaccatttatcaccagaatatttacggcgacaagtgggggtggtgatgcaggaaagctatctgtttaaccgcaccgtgcgagaaaatattgcccattcacggccaacagccaccttgaccgaggtggtcaatgccgccagtttagcgggtgctaacgcctttattttggcgctacctttagggtatgacacggttttatctgaaggtggttcatccttatctggtgggcaacgtcaacgtattgccattgctcgcactctgctcgcgaatccccggatcttaatttttgatgaagcgaccagcgcactggatgatgagtctcagtcggagattcagaaaaacatggcccgcattatcgccaatcgcacggttattacgattgcccatcgcctatcgaccgttcgtcactgccaccgtattgccgtgataacacaaggccgagtcaccgaacttgccagccatgacgaattactgcaattaaacggcagttacgctcggctttggcaacaacaagttcattttaaccaaaacaagtccactttaactaaaacaagtccaccttaactaaaacaagtccaccttaactaaaacaagtccactttaaccacggggaaataaaataaatattatgtctgcgtttattcagcacataaaaaaccgctggacgcgttgttttacccccgcgcgtacccgtgatgaatatgattttttgcctgcttatttggaaattgtcgagcgcccgattgccccattagcccgtcgtacagcgtggttactcatactgacattattgctggtattgatatgggcgattattggaaaacttgatatccatgcctcagccagcggcaaagtgattgttgcggaacattccaaaattatccaacccgcagaacctggagtggtgacggaaattaatgtccgagatggggataccgttgatgccgggcaggtgcttattgcattaaaccctattggcattgatgccgaagtacgcaatatcaatcagcaactacagtatcgtcagttagaagccgctcggttagtggctctcctggctgatgaaccgctaaaaaatttcaagccgccttataacagccctgaatctctggtggtggcatccagagcactgttaacaaaagaatatgccgaagtgacagctgaattgtcacgtcaggatagcgaactggcggtgaatcaggcgcatcttcaggccggaattgagcacaactctcatcaaaaagcattgctgaaaaatattcatcggcggctacaagcgtcgcgtacgctggctaaatctaagtcaattgccgaggtcgagcttctggtacaggagcgggaatggttaacggcaacggctgaagccaaccgtttgcagagtgaacaagatattttacgggccaaagcacacagtttggcgcaaacccgtatgcactatctggcgaaaatagaccgtgataatcgggagcgattgaataaaacccacgaaattattcatcagcttcagcaagagcaaatcaaaatgatggataaacaacgccagcaaaccctaagagctccggtggctggcgttatccagcaattagcggttcataccttagggggggtggttaccacggcgcaaccgttaatggttctggttccggaggattatcagttggaacttgatgtcatgatcctcaataaagatgtggggtttgtcctgccaggccaagcggtagaagtcaaagttgacagcttcccttatacccgcttcggtacgttatccggggaagtaaaacatgtttcccgtgatgcaatggaagatcaacaacggggactggtatttccagcgcgtatccgtttactcagcgataccctgatggtggagggtaaaccggtgcggttgtctgcggggatggccatcaatgcggaaattaaaacaggtcgccgtcgggtcattgattatctgctgagtccattgcagcaatatcaatctgaagccatgagggagcgctaacatgacggagtcttattcaactctggccgccgagggcaccaaggttattcagccactggaggcgttggcgtatgctgctacctgttttgatttaaccatcgaagcttcgcaattggcacaccaactaggcttagctcccgatgagatagacagtattgccttgtgccgttgtgctgcttggatagggttacgagcgcggaaagttaatcagtcttttgaacgtgtgggaaagctggtattacccgttttattcagtgatggtgctcagtggtatgttttgctgtcgctgaccgcgcaggaggccactgtctattttgcaggcagcgaccagacgcggaaaataagtccagaagtcctggcaaaattgtggcgcaatgaggtgattttgctggcgaaagcggaaccgataacggccaaaaagcagtttttcggttttagctggtttattccggtggtgatgaagtcccggcatcagctacgtaacattattcttatctcattactgctacaagccattttactcgtcacgccaatgctatttgaaaccgttatcgataaagtgttggtaagccgcggggtcgatagtttggtggttctaggtggagccatggtggcactggcgattgctgaaccggggtataccttattacgtagctggctgtttgcgcatttgtccagcagggtgggggctgaactcaatacacagttatatcggcatcttctggggctgccactggggtattttaccggccaacagacagggcaaactatcgccaagatgcgagaaatggagcaaattcgcagcttccttacgggctcagccctgactatggtgttggatctgttttttgtcgtcacctttattgccgtgatgtttcgctacagtggtcaattgacggggatcgtattgatttccctgctttgttatctgctattttggtcggcagttggggggcggttacgcaagcgagtggcgcagcaatacgaaaccagtgcgcaagcaacctcgttcctgaccgaggcggtcagcggggtggaaaccatcaaaacctcggcaaccgaaagtcagtttaaccggcgttggcgtcaagtattagcacgctatgtccgggcctcttttggcagttcgcaggcagggaacttggcaggccaagggatctcgctcattaataaaataacgtcagcaattctgttgtggtttggcgtgaccctcgtattggctggaaaactcagcccaggtgaactggtggcgtttaatatgtttgccggttacgttacccaacctatattacgattggctcaggcatggcaagacttccaacatacgcagattgcgctggagcggattggcaccattctggatagccccaccgaacccggaagtgccgggctggttgccaactgtaaacgggcagggagcttaagttttaagcaagtgcgcttccgttatcgccctgataccgcagaagttttacaaaatctcaatctggagattgccggtggagaatttatcggcattaccgggccatcggggtgcggtaaatcgacactgaccaagctaatgcaacgcttatatacgccacaacatgggcagattctggtcgatgggcaggatttggcgattactgaccccaccacgctgcgccgtcaaatgagtgtggtattgcaggagagcgttctattttcgggcagcattcgggacaatatttgtcaatgtcggcccaatgcagatgaggctcatgtgatacatattgcccggttggccggggcgcatgattttattatagcgttgccgcagggttatcaaactcaggtcggtgaaaagggggggctgctttctggcgggcaacgtcagcggattgcactggcaagggcgctgatggctgatcccaagattcttatccttgatgaagcaaccagtgcgttggactatgaatcggaggcggcgattatgcgccaattaccggaaatcacccgtaaccgcacggttatctgcattgcacaccgtttgaatacactacgtcagtgccaccgcattttgttactaaaagatgggcaaattgcggagcaaggtagtcatgaagtcttggtagcaagtggtgggaattacgctcgtctgtggcaacagcagacagagtagaagtagaagtagaagtagaagtagaagtagaagtaatggtaatcgtgctcaccggtattcattgaagggggcaatgagaatatagttataacgcaatgacaatatagttataacgcattgtcatcatggttataacgcattgtcatcaccctcaggagccaacaggcctctgagggtgtcgctatcatagcgaattttataatactgatttttccaatactaaaaatcatacccaacaacattagcgattgagctgatagtacacctcgttccaacggatttcgtttttgaacgccggtaacgtcgtgtcattgtcgatcaacaagaattcaataccgtgcatttcggcatataaacgcagttcatcgacacccaccgcttgtgagaataccgtatggtgtgcgccaccggcgatgatccaagcttcagcagccgttgccagtgaaggttgtgcttgccagatagcccgggcaaccggtaattttggcaatggatgaggttgttcaacggtatcaaccacattaaccagcaagcggaaacggttccccatatcgatcaaactggcattcagcgccgggcctgcgggggtagagaaaatcaaacgggcagggtcagctttccctccaatgccaaggtgttgcacatccagcaggggcttctcttctttggcgatcgacgggcagacttccagcatatgtgagccaacaactaagtcattacctggctggaagttataagtgtaatcctccataaaggaagtgccgcctttcaggccggttcccatcacttttaagatgcgcagtaatgcggcggttttccagtcgccttcgccaccaaaaccgtaaccctgttgcatgagtcgctggactgccaggccaggtaactgcttcaaaccataaagattttcaaagttagtggtgaaggctttaaaaccaccttgctccagaaaacgcgtcatacctagctcaatacgtgctgcatccagtaagttttcgcgcttatcaccattgagtttcaccgcatcggtaaagcgataggtggcctcatattcttcaaccagcgtatcgatatcacctttactgacggcgtcgaccacggcgactaaatccccaatgccataagcattaacggaatagccaaattggatctgggcagcgactttatccccttcagttacggcgacttcacgcatgttatcgccaaagcgcgccactttcagttgttgactttcttgttttgcggcggcgacgcgcatccactgaccaatgcgctggtgggcttctttatcctgccagtgaccggttatcacactgtgttgctggcgcatgcgggcaccaatgaaaccaaattcacggccaccgtgtgcggtctggtttaggttcataaagtccatatccatcgtttcccacgggatttgggcattaaactgggtatggaactgtaacagcggtttattcagaatgctcaggccgccaatccacattttggccggagagaaggtgtgcagccaggtcatgataccgatacaggccgtgtcgtagttagcttcacgacataatgcggtgatttcatccggtgttgtaaccaacggttttaataccagttttacgggtaaacccgcttcgctgttcaggctattgaccacctgatgtgcattatccataacttgttgcagggttttagggccatacagattctggctaccaatgacaaaccacacttctgattgcttgaatacgtccatctatcactccatttaataaacgattactcgatataaaacattcagttatcgtgaatgtcgttaaagtagactgcttgtcaatatcagtgaattgccttggtaactggcgcataatgcggctctgccgtatgacaccactgctgatagcgttgataaagttgctggtaacgcacgacctggacgggatccggaatcagagtgcgctcaatattgcatgccatgtggcgttgggcggtgggaacatcctcgtgtgcccctgcggcaacggctgcaaaaattgccgcccccagcgcacaacattgatcagatgccacaatctgtagtggccgattcatgacatcagcacaaacctgcatgatcaccggcgatttacgtgcaattccacccaatgccagcacgttctcaaccgggatatcttgctgttcaaaacattccataatggcgcgggcaccaaaggcggtcgcagcgataaaaccaccaaacagggttggtgcatcggtacccagattcagatcggtaatcaccccttttaaacgctgattagcattcggggttcggcggccattaaaccaatccaataccacgggcagatgatcgagagacgggttttgtgcccatgcgcaggtcaatgaggcgagtaggttggattcgatctgttttagctgcggctgccattcgggttgggtcaatgccgcttgatgcagtggccaactcaacaaattgctgaaccatgcatacatatcaccgaatgcagattgacccgcttccatgccaatccaacccggcaatacactgccttcaacctggccacagatacccgcgatagcccgatcacccactcgttggtcatcggcaatcaagatatcgcaggtggacgtgccaatgactttgaccaatgtataaggttgagcaccggctcccaccgcccccatatggcaatcaaatgctccaccagaaaggatcaccgtcgttggtaagcccagacgctcagcccactcggcggtgatctggcctaccggtcgttcggcggtgtaggtgtcagtaaacatgggataatcgagatcattaaccaggctggtatctaatgctgcgaggaacgctcgtgggggtaatccgccccatgaagggtgccataaacttttatgtccggcgctgcaacggccacgctggatatcctgcggtgcggtggtaccagacaagagggccggtacccagtcacacagctcaatccatgacactgccgcctcacgaacagccacatcagcacgggtgacatgtagaatttttgcccagaaccactcagaggaataaaccccaccgatatagcgtgaatagtccgcaaattcaccgctacggcataaacggttaatttcttcggcctcctcaattgcagtgtgatctttccacaacacaaacatggcattggggttatctgcaaaatccgggcgcagagctaatacttggccttgctcatcaatcggcgctggcgtcgatccagtagagtcgacaccaatacccacaatatgttgacgttgttcttctgacaggcgcttgaccatctgccggatggcctgttccatcgcttcaatatagtcgagaggatggtggcggaactgattttgtgcggcctgacaatatagacctttcttccaacgtgggtagtaaaccacttccgtatcgatctcagtgccatgttgacaatctaccgccaatacccggacggaatcgctaccgaaatccaacccgagagctatagcaccgtctgccgatatcacgttgcctgtcatggtggttgctcctaatcatgcaaaaaaaacagaaattcattggcaataaccataagagtgagccgaggggaaacgtgaggagccaatagctggaagtatgcacttttctgcttgttggtctgtttttgtgatgtcagtcaaaagttagcgcgaggttaaatttgctgaatatatggataaataaactgtaatctctggatgtgatagcgctctacattctgaagtctatttaacgctaatactgtcttcgtcttacacgatgtggtgtggtgatgcggccttaaataaagcacacggccatactgaactgaaaaaactctactgataacgtttccactcatttatttcaatatgagtgactagcgattaaataaacaagaatcataaaaacagtctggagaatactatgcataaattaactaaggcgctggcagtagtcgggttagcggcggttatgtcacattcagctattgccgaaagtatgaaactgggctttctggttaagcaaccggaagaaccttggttccagactgaatggaagttcgctgataaggcgggtaaggatttaggctttgaagtgatcaaaattgccgtacctgatggcgagaaaaccctgaacgccatcgacagcctggcggccagtggcgcgaaaggtttcgttatctgtacaccagatccaaagctggggcctgccattgaagcaaaagcgcgcagttataacctgaaagtgattgccgttgatgaccaatttgtgaatgccaaaggcaaaccgatggagagtgttccgctggtgatgatggcagccactaaaattggtgaacgtcaggggcaggagttgtggaaagagatgaacaaacggggttggcaacccgctgaaacagcagtaatggcgatcacttctgatgaattagataccgcgcggcgtcgtaccggcggttcaatggcggctctgcaagcttctggcttcccggaaaagcaaatctataaagttccgactaaatctaatgatatccccggcgcatttgatgccgctaactccatgctagtacagcatccagaagtgaagaattggctgattgtcggcatgaacgataacaccgtattaggtggcgtgcgtgcaaccgaaggccaaggttttaaagcaccgaatgttattggcattggtatcaacggggttgatgccgtgagcgagctgtccaaaggccaggcgacgggtttctatggctctttattacctagcccggatatccatggctataaaagtattcagatgctgcatgactgggtcactaaagatgtcgaacctgcaaaatttactgaagtcaccgatgtggtgttgatcactcgggataacttcaaagccgagttagagaagaaaggcttattgtaatcccgatacacgctatggcgcactgggggcaggctacggcttgccccaatagcctacgggtggttcggtgcaacccaaactttataaggaagccatcatgtcagcaccccattctgcgttacaagccgagttggacgccgcacagtcaccttatctggcttttcgtggcatcggaaaaagtttccccggtgttctggcgctggatgatatcagtttcacctgtcaggcgggccagatccatgcgctgatgggcgagaatggcgcggggaaatcaaccctgttaaagatcctcagtggtaactacaccccgacacagggtgaaatccacattaaagggaaagccgttaactttaccaatactacggatgcgttggatgctggtgtggcgatcatttatcaggaactgcatttggtgcctgaaatgacagtggcagaaaacatctatctgggccaattacccaccaagatgggtatggttgatcgaaaattgctgcgttatgaatctcgcatacagctatcacatctggggttggacattgatcccgataccccactgaaatatctctccatcggccaatggcagatggtggaaattgccaaagcattagcccgcaatgcaaaaataatcgcctttgatgaacccaccagttcgctctctgcccgagaaattgagcaactgttccgcgtgatccgcgagttacgggccgaagggcgggtcatcttgtatgtctcccatcgaatggaagaaatttttgccctgagtgatgccattacggtgtttaaagatggccgctatgttcgtacgtttgatgatatgacccaagtgaataatgcgtcactggtgcaagctatggtagggcgtaatttaggggatatctatggctatcagccccgagagataggttctgaacgcttaacgctacaagcggtgaaggccatcggtgtggcctcgccgatcagcttgactgtacaccaaggggaaattgtggggctgtttgggttagtgggggccgggcgtagtgaactgctcaaggggctgtttggtgacaccaaactgaccagtgggaaactcttgcttgatggccaaccactgactatccgttcgccgattgacgctatttctgctgggatcatgttgtgtccagaagatcgaaaagcggatggcattattcctgttcactcggtacaggacaatatcaatatcagtgcccgccgcaaaacattaaccgcaggctgtctgattaacaaccgctgggaagcggataatgcgttgctgcgtattcagtctctgaatattaaaacgccaggcccccaacaactcattatgaatctatccggggggaatcagcagaaagccattttaggacgctggttgtccgaggacatgaaagtgatcctgttggatgaaccgacccgtggtattgacgtcggggccaaacatgaaatctataacgtgatttatcaactggcgaaacagggcattgcggtgctgtttgcttccagtgatttgccggaagtgcttgggctggcagatcgtattgtggtgatgcgtgagggcgctatctctggtgagctagaccatgaatatgccactgaagagcaagccttaagtctggcaatgttacgcaccccgaatattgccaccaataccgcgtctgcggttgcctgactgtgaaggagttaatcatgtctagcgttactttgagttcggataaaaagaacccggtatcaactgaatcaaaaggtgggatcccacaacctcagcaaccacagaatgcgccgactaaaagtggcttaggattatcccgtatctgggacagctacggcatgctggtggtcttcgccgtggtctttattggttgcgtgatttttgtgcctaattttggctcctttatcaatatgaaagggttggggctggctatctcaatgtctgggatggtggcgtgcggtatgcttttttgtttggcatccggcgattttgacctctctgtggcctcggtcattgcctgcgcgggtgttaccaccgcggtggtgatcaatatgacagagagcctatggataggggtgggcgcaggtttgttattaggggcggcatgtgggctaattaatggttttgtgattgcccggctaaaaatcaatgcgctgatcaccacattggcgacgatgcaaattgttcgtggcctggcgtatatcatttctgatggtaaagccgtgggtatcgaagatgagcgcttcttcgccttgggttataccaactggtttggtctgccagcacccatctggatcaccgttgcctgtttggtgctgtttggtttcttactgaataaaaccacctttggccgtaacacgttggcgattggggggaatgaagatgctgcgcgtctggccggtgtgccggtcgtgcggaccaaaatcattatttttgtgctgtcaggtttggtgtctgccgccgcagggattattttggcttcacgcatgacgagcggccagccaatgacctcgattggttatgagctcattgttatctctgcttgcgtattaggcggggtatcactaaaaggcggcattggtaaaatttcttacgtcattgcggggatcttgattctgggaacagtagaaaatgccatgaacctattaaatatctccccgttctcacaatatgtggttcgtggtttgatcctgctggcggcggttatcttcgaccgttacaaacagttagctaaacggacgatataaggttacggtgactgaaacgtccataaaaatctctctagttcacagttttagcatcacgctcgggcagcataacacctgcccgataaactgaaagaagttaatggataacgcagtgagtggcttttattcatccgagctcactgacgtgaacctgattgtataaaactgactgcataaaactgatcatataaaaccgattatatgaaaccgaggagccaaaatgtatcaacgcatggttcaggaaccgcaacccaatcctttgctaccaggctacacgttcaatgcttatctggtcgcaggattaaccccgattctggctgacggcccactcgatttcttcattgatcggcctggcggcatgaagggctatattctgaatttgaccattaaggggcaggggaagattttcgatggtgaaaataccatctacagtaatcctggtgatttactgttgttcccacctaagtcgcctcaccattatggtcgttcaccgaatagtgattgttggtatcaccgctgggtctatttccgaccacgggcttattgggccgattggttggaatggcacagtaaaacccatgaggtagggcgtttatctttacctaacaataacttaatgctggagtttgaccgcttatttgccaatattgagcagacacagaaatcggggcggcgcttcggtgaagagttgggtatgaatttgctcgagcggttactgctacgagcaatggaagaagacccacttagtccacaacgtattatggatccacgtattattgaggcctgtcaatttattaccggaaatctggcaggggaattacgtattgacgaagttgcccgccatgtttgcctatcaccatcacgcttagcgcatttattccgtgaacaggttggcattaatatattacgttggcgtgaggatcagcgggtgatccgggcgaaattattactgcaaacgacccaagagccaattgcgaccattggccgggtggtaggctatgatgaccaactctatttttcccgtgttttccgtaaacgagtgggggtcagccccagcgatttcaggcggcgcagtatcgaaactaactatccacaacgtacttttcgtccagcggactggcaggataatcagggggcattggtgcgggtttaatcccgcccgttacggttaagcagaaattaccccttgtccctggatgcatcatagtgtcaaatcgattaatcgtgtgatatctaattgcgatatcaaatagcgggtattctgggtaagaggaaaggtaatggctgataagataaaagtaggtttactgggctacggttatgccagtaaaacgtttcatgcgccgttaattatgggcacaccgggcttagaactggctggagtttccagcagtgatgccagtaaagtgcatgccgattggcctgcaataccggtagtatctgaccctcagatgttattcaatgatccctctatcgatctcattgttattcccacgcccaatgatacccacttcccattagcgcagagcgcactggctgccggtaaacatgtggtagttgataaaccctttaccgtgacgttgtcacaagcaaacgcgttaaaagagcacgctgatgatgcaggtttactgttatcagtattccacaatcgccgttgggacagtgacttcctgacgttaaaaacgttactggccgaaggctcgctggggaacgttgtctatttcgaatctcactttgatcgctaccgcccggaaatccgtcaacgctggcgtgaacaagccggtgcgggagggggcatctggtatgatttagggccacatttactggaccaagcgttacaactgtttggtctgccagaaacgttgaatgtcgatctgggcatgttgcgcccaggctctcaatctgttgactatttccacgcggttctcagctatccggggcaacgcgttgtactgcatagcacggtattggctgcggcagaaacggcgcgttatattgtgcacggtacgcagggcagctatatcaagtttggtgtggatccacaggaagaccgtttgaaagccggtgagcgtttaccacaggctgactggggctacgatatgcgtgatggaatcgtgacactgtcacatgataatgtgcttaccgagaaaccgctactgacgctgccggggaattatcctgcgtactatgccggtatccgtgatgctatttggggcactgcgcctaatccggttccagccactgaagcgattaaagtcatggagttgattgagttgggtattgcttcagatcaacagaaaaaagcactgccgatcattgctaaaaattgatgtttatcccgctctaatggggcggagtaagggtggaaatatctctctgggcacaatctccgtggcccagagtttttttatttttttaaagacaaaccattggtttaaagcagagctattggtctaaataagtacttttgattaaaaaacactattgattaaataaatacattgggttgaaggaatacagtggatgtcatggttacaacgcttacagatagataagtttttgttagtgctgatactggtggttattatcgcctctatcttcccttgtgaaggggaaaccaaagtgtggtttgaaaggctgacgaccgccgccattgctttgttgttctttatgcacggtgccaagttatcacgtgcggcaataatgacagggatggggcattggaagctgcatttggtggtttttctcagtacgtttgcactatttcccctgttagggttggggatgaatgtactggtgcccaatgtgttaacacccacgctatatttagggtttctctatctttgtgctttaccggcaacggttcagtcggcgattgcgtatacctcagtcgccggggggaatgttgcggcggctatctgtagcgcatcggcatccagtatcctcggggttttcctgtcacccattttagttggcatgttgatgcagacacagggcggtgataccgacaccttacatgctatcggctccatcattatgcaattaatggtaccgtttgttgtggggcatctatcgcggccactgatagctaaatgggttgaacggcacaaaaaactggtcaatatcactgaccggtcatctattttgttggtggtttatgtggcgttcagcgaagcggtcgttcaagggatttggagtcaaatcgacggctggtcacttttggccatatcagtttgttcaatggtattactaacggtggtattggtggttaataccctggcctctcgttggctgggctttaataccgctgatgagattaccatcgtgttctgcggttcgaagaaaagtttggcgaacggtattccgatggctaacgtgttgtttcctgcctcagtcgtgggggttatggtattgccgctaatgatattccatcagattcaattgatggtctgtgcggtactggcacaacactacgcgaagcgaatggcgagagaacaagctgaaaaaggactggacgtaatgccgacagtaaatgacagtaaaactcagtgagccgatgctaacggtagattggcggcaggctgttgttattttgataaataaaagtttgttgataaaagtagcctggcgataaaaagggcttagtgatgaaaatagaaagcgccggtaccactctagggtatgggcgcttttttattttatcgtatcttcgggttctatcgtacctcaggaaatagggaatactttatcccgcagtgcctgcttttcttgttcgctgataaatgccatttccaggccattcgcttgtgcttggcggatttcatgcggcgttagccccgcagccggtgcagcgacaaggtattcattggcaatttcaatgccctgaaccgccgggtcatcagtgttaattgatgccacgatgccatggcgtaggaaggttgctaatggatgggttgccagagagactacagtgctggtttggatattggaggtcaggcaggattcgatacctattttgtgttctgccagatagtccatcaacttacggtcttcgacggctttaacgccgtggccgatacgttcagcacccagttcacgaatagcttgccagatactctccggaccggccgcttcacccgcatggacggtaatacgtaggcccgcatccctcgctcgattaaaatggcggcggaacagagaaccgggaaaacctaactcgtcaccggctaaatccagcgcggttatcccttcgcgatgggccagcaagctatcaagttcttgcaaacacgcttgttcaccgaaggtgcggctgagaatgccgatcaaacggatatcaatattaaaatcgcgacaaccagacgcaatgccatcaataaccgcttcgacaacaccggtaatcggtagttggtgtttcatcgccatataaaacggggaaaagcggagttcagcataatgtaaaccagcatgtgctgcgtcttcgacattctcataagccactcggcgacaggcatccagtgatccgagaactgcaacgccccaatccaacttttgtaggaaactgaccaaatctggctcggtcttggtgatttgtacgtgtggtctcagcgtatcaagctcattggccggtaaattcaaattaaattgttgacccaagtccaaaatggtttgcgctcggatattgccatcaaggtggcgatgaatgtcggtcagaggaaggcgaggatcaatcatgctgtgcactcactttttatcaaagatagatttcggtagataaggtgcagaatattataaaaacaaacgaatgaaaatatccatagtgttacataaaaaagtgataagagttttatttcaacttgcaggtatgttgatcgttctcgctcaccctaaatttcctgaattttgagctatcaatatataatacatagcgaattgaaattatttttttaatattacatgcttttttttgatagtaaatatcatctattgtaaggactatatattaagtatcagaatgagcttaatacatgacgatttttgagtgatgaaaggattggctactttaaatcagcgtggttagctcggaatattaaatcattagcaatgagataaggtattatttatgttaacaacaatgtttttcaccaacccattccaagtcaataacgtgtctttagaacgtagtgaagatagtcatcagcacacaaaagtggaaatatatgatgaacttttgggtaagaataacgtgactatatgcacaactgaaaatctcgatagaaaatcacatgactactttgattccaaaaaacatgaaatatcctacaatgacaaaaaacatggtgatataaaactgacaatttcaggtaggggtaggcacgaagacattgtgatatttaaatcaggaactaaactagatgttccagaatatgtcgaaagaaacattctgtctatgaatgggacattttctcataatgaaatgcatgtattagaaggtattatttcaaaaaaaaagggcagggggaaagaagtgtttccctatgtggaactaaatgaaaatgaagtgaaacatggagcttcgacgtcgagcaaagattttaagagtttgattgattttagattgaagaggaacccacaagtaaaagaaatactgatccctgtgttatcgaataaagatcattggtatgcaatacatatagagatagataaggatagtaataatttaacccctacaataataaacaccacaaatgaggcaaaagtaaaagatagttatgattgtatattaaatggctataagaaaattcagtcattattgggcgaaatgtttaaggaaagtgagatttttcatgactttaatatcggtgactttaaattttgtcaatcattacaatatggtaatatggggtgcggaattacaacaaatttaaatgaacaagctattttaaatgggaaaatggaaatcgatgatttggcgtttaccaaagaatcatttagaacaaatgaacaagtgttggaaatgtcaaatattgatgttttttctgaagggaaaaaatatgtttttttcggtaaaaaagcggaattggcaaaaagatttaccgaattgttaggggatgactgtatcccctcaataatgctaaaacaagaacattatgatgaaaatgacttcaataatgacattggtgcttttttcaacggagatttagaaataaaacaagtagagttaagtattaacattccaccgtatttgataaaagacaaatctcaaagaagtaatttagccattgaatcaataagaagggctgacctcgccttgaattacttggagagaatggagaagaaaaatgctgttcttacggagatactccattataagttttgagcctgtccataattctgtgtaaacaccacttggggttctacgccggaatcccagatttttccgtcacccctgtttcaacctggcaaccttcgctggattgttgctgtactgaagccattttgtcagtacattcattaatcactgttatatttcttattcaaggcgaaatttattatcgattaattgaccgtgcaacccgggcataggtatgcctcacaccgcgaatcactatgctataagcaagaatattctccggtaatgctatccccatgtaaccggtatcaccaatatgatgtagatctgctcctgccattttactcatcagtgctatctggcgaattgtatgggtgtctgcgccttcctgagaggtacctatggccgtcattgccagtacgccatggccatgagcagtatcaacaagcgatgctacacgctgctggctcattccgggcaccgttcccggtgccggaagtaaaacaatatcggccccctgtgaggcgaaccagataatatcctcttcgctgacaatgtgactaccgctttcctgtacgactcccgccccgtgcatttttccggcgatgatgacagctttgtctttaactgcatcacgaatgtcccttacagccattcccaaagcgtgattactgacgccattattgggattgccggtaagcaccaggatcttcgctcccatagcaaccagcttacgggcgttttctgcagttgctgcgcgccctggtttcattctccagatatcgttatgagcgacagcaaactcaggatcaactgcctccaaattcacaccaataacgcgtcccgtcaggcgttgtagctcatgcagtatgtgctgcggcgcaatatctgccggcagcccctgaatctgagggttttcgcaatcaaacatattaatcagtaagatatctgcgccttgtgatgcggcaagttctgcattggtaacattgttcagtaatggttgagtaatcgcgatggtttcactcaccattacccggccttcactggcgcggatggcatacagaagttctgcattatccatcgaaacaaaatcggaagcacagcaatctagtaaacgtttttttgtcataacagcattaccttattgattaactaattcacgaatggttgccctaatcgtagtagcagaccggctatcggtaaaacggcaatcggcagcatcaggtccttaccctggcgctgtatcatgagaaagaagtttcctgcataaactcacctcaaaagtagcagggcaggataagaaacaacggataacaaaccaatagtgtacctttagtgaaccttacatgaatggcctctgttatctgtagttccatctgtttgttttgtgatctgagttactttaaaggttttgccctgtcattttgatgatgacaatcactgttccctggataacaattggttcactcactctgaaccagacaggacaatcacgaagcctgatgaatacatctccagcacctgaatttcaccttgataaatccagtagattgccactctatttgcaactggttaattccataaaatctgcaattactgaagggcgtttacatgcaggtgatgttttgccaccagagcgggaactggcagagatgctggatattgcgcgggggactgttcgtaaagccttactacagctacttgaaggcggcgttcttgtacgcaatcagggcgttggtacatttattgcgccgcatgtatgcccgtcgttgccgctactggagagttttagtgaaatggctacggccagcggaggtacggcgcaaagtgaactgttgggatatctgcggcgcccatccgcactggaagaacgtagtgtcttgcaaatgacacaggataatggcgacgtcgtggaactgaccagactcagaaaggttaatggtattactgtttccctccagattgcgattttaccggcgcattttctggataacatcagtgaactcgatgagtctttgtattggcatctggaaaaaaagggagcacaagtattgcgggcaacccagcacttcagcgcagcagttacggacagtacattggcgcactacttgggcaccgatgagtatgagcccgttttactagtaacccgaacaggctttactcataacgatcggcctgttgaatatacccgaacctggtatcttaacgattactgtgattttacgattgatctacaccgtaaagatctataaatacaaaaagcagatttgaacgttgcttacagcggcctcgaagaggcgaagcccatagatggggggagtaacgaacgcagccaacgcacatgcagtttgaagtatgaagtatggagggtaataggtatgacgaaggaggggagtaccttatatgctgtggtcattggtaatgaatggagacattttctatttaaaataaagagggtggttcgcattaaaaacggagccaatgggctccgtttttatcaaacaaatataatgaatagtttattgtgcaggagcaggctctgcgggtacgactaagtcaaattctggtgtttcttgtgactcagggccgctatcaatatcttcctcctcttctccctgtgcaccaagcagattaaacaggccagcaaattcttctggtgacattttctgaccattcaattcgacttggttgtcagcaaactggagtttactgctgattacatcatctttagtggtggtcagcctaaacatctggcccattgcagcgagactctggacttgttgctgtgctgaacttttcgcttcttcctcgctgtaaccttgcaagcgggcggcctgagtgactaattctgtagccatcgccattggaatgctcaggttggcgtccaattttttcaccgcgggtgctatcagtggtttttctgttgatttagcttgtgtcggatcggtcagttcgatattcagggtaaaggtactttcccctttagtatttttccagctcagtggggcaatgctcactgcagggttacctttcagcagcgcaggaaggtttgccatgacaacttctctcatttgctgttgagaggcaagttgatcaacactttcagctagctgtactcgcttattataagcgctgatgaactgcttcagaccctcaccgttgaaacggtcaaaagcaatagtcaattgcgctgaaccaaagttattatcctgaatttttaaagcatcaagggtatagctcagtttgccatttaaatctttatcagtttcgctcaattgggtcttcagattaaagccaagcaatgtcgccatgttcttgccttcatggctgatatctatttgcttaacaccaatctgttggtcgccaatgctgatatcgaacttacccgctttactgtcacttttcagcgttagcccttgcacactgacttgttctgtttgatccaaataattctttttggaataaataaaactatcgctgctgccgctcatacttacattatgcatatcacgagagacatcggcattgatagtggcaccggagaacttcacgttagtgctattttgcttatagttgattggaatgaaagtaatagcagaagaggtatcgccaccgtaagaaatacgcgaatcagcagtaaaaggcgactggccgttggtcacatcaaacaatttcttcagcactggcgtgttagccaactcagtatgcactgacgccatgctaggaattaggtttaatttcttcaactgagctaatgggaacgggccatgatcaatgacttcaataaaggcgatttcatcaccatcgctcaatactttttcgccaggaaaagtattatctgattgtaaaatataacggaccttactggagaacagaccgcgttggtaatctttataagcaaatttgacacccacgtttggaaacgctgtcttgatctgtccgttggcattatcaaccagctcggtcatgcgttgttcaatcagtttaccggtataccaagaggctccagtccatgctgcgccgagtacgacaatgacgctgacagccactaacgattttttcattgttttgttcatccttttccaatgtaccaaattcactatattgaacgcggtaatgagtgatttaagaagccccacctaaagaaggaaatccccaaaaaagaagatatatctcccaaataatataggcctagagtgcctatacacaaatattatcgcgaccgtaacaaggacttaatcgcgacagagccttcaatttatggtgagaagctatttattgacaacaaattcattaagttagttcacaccgcgttataaacacgagcaattgaaccccccccttgcacggttacaggtgattccttagccgatatgaagcaagactcaccagggtgcagcgtaatttcttgctcttgttttttcagcaccgcacagccttcaacacaaaaaataattgccgcactgtgttgtgccagaacgtgtggttcagccaccaaggtatgcagtgagaaagcgaagtcctcgacaggaatagggaatatcagttcattaccctgttgctttggtgttgtgagtagggcattagccggtttagggataaattgcagattggacattaactctggaatatcaataaacttcggcgttagcccggctctcaacacattatccgagtttgccatgacctctaatgcaaccccattgaggtaagcgtgcggtgtttcggcataaaggaacatggcctcacccggttgcaatgtcacgacattaagcagtagtggggagaacaacccgctgtcatcgggataaaaacacgaaatgctgcggatcgtatcccaaggctctccgagttggctattcaatgccgctttcagaataccgagtgcccgcgtttttgtctcaccgctcatactgagtaagctggcaaataaactggctaaatgctcagtatcgggttggcgcaagaacgcggcaatatcagggtgtgccgctgctagtggttgtaacagcgcctggatatcttctagtgtgcgaaaaccattcattgcctgaaaaggggtgagggcataaaccagctcaggcttatggttcgcatctttataattgcgctcagccgcatccagtgggatacctgcctggttttctttagcaaaaccgacctctgctgccgctttgctcgggtgaacctgaatcgatagaggttgagctgcacaaagtactttgaacaggaatggcagttcaccaaagcgcttgaaaatatcactccccagcgtgttatctggatcttgatcaatcacatcacgtaatgaatgccactggccatttgcgtcaagaacctgggaactgcttttcgggtgcgcccccatccacagttcagccattggcattccttgtgggttaggtatgccataaagctgggtcagggcatcagtactgccccaagcatagttttgaactgcgttattcatttttagcatgtttatgatctgccgtttgcaaaggactaaaataaggctgcgcgttagccagtgattaaccggttctggatagcaaaccctgaaaaaataagccattagtagacaatgaggctaaaggtgttgcaagtggtaatacgagcatcaccaaagtagccatcacaaaattccagaaatgcgaatcaatcgcataagcgcaatactatctgtgtcattataaccgctatgtcgtaagcctatgctagctcaacatcaatcttttgttctaaatgctaaggaggcagtgatggcaactacccgcagtgaaaaggattctatggggtctatctatgtacctgcaaaccaattatggggggcgcaaactcaacgttcattggcgcattttcgaatttcacaagaaaaaatgccaacagagctaattcatgcattggctctgaccaaacgagcggcagctcaagtgaatatggacctaggcttgctgccagccgagcgtgcaaaagcgattatgcgggccgcagatgaagttctggatggcgctcatccaaccgagttccctctcgccatctggcaaaccgggtcgggtactcagacgaatatgaatatgaatgaggtactggcaaaccgtgcgagtgagttgctcgggggggcgcgggggaataaccgtttggttcatcccaatgatgatgtcaataaaagccaaagttcaaatgatgtcttcccaacggcgatgcatgtcgctgcagtgatgggggtgagtgaacatcttcttcctgaactgaaggtgttacagaaaaccttggccgacaaagcagaagcttatcgcgatattgtaaaaattggccgtacacatttacaagatgcgacccctttaacgttggggcaggaaatttccgggtgggcggcaatgttatctcacagtgtgcggcatattgaggcgacccttcctcacctgtgtgaattagcgcttgggggaacagcggtggggactggcctcaatacgcatcctgaatatgctgtacgagtagctaatgaaatagccgcactgacacgccaaccgtttatcactgccccgaataaatttgaatcattgggaacctgcgatgcattggttcatggtcacggtgcgctaaaaggcttagcggcatccctgatgaaaattgccaatgatgtccgttggttatcatcaggccctcgctgtggtattggcgaaatatctattccggaaaatgagccaggcagttctatcatgccaggcaaagtgaatccaacacagtgtgaagcgatgaccatgctatgtgctcaagttatgggtaatgatgtggctatcaatatcggtggggcgtccggcaactttgaattaaacgtgttccgtccattggtcatccataacttcctgcaatctgttcgtttgttggctgatggaatgcgtggttttaatgagcactgcgctttgggaattgaacccaaccgcgaccgtattacgcaattgctcaatgaatcgctgatgttagttaccgcgctcaatacccatattggctacgataaagcagctgaaatcgccaaaaaggcgcataaagaggggctaacactgaaagcagcagctatggcattgggttatcttaccgatgcagagtttgatgaatgggttcgaccggaagatatggtcggcagtatgaagaaatagcggataaacattgttatattaacgccggggtggattaccggcgtttttacagtggctaagccgcaataaatggcattttttacggttccagttcgacataaagatgcaagcgcggtaccagcaaacgtagcggtttcgcatcaggcttatatttatgcttgatatgcttcacatcataatcggtcaactcgcctaatttcggtagctcggcccctgactgacgctgacagaacgcaatcaggggcatggggcaggggtgttgtacctgtttttgttgttcttgataccatactcttgcgatgggctgcacttttacgggccttttaattttcagccgtgtcttttctggcaaacgctgcacatcatttatttccaagctaatcagttccctccattgctcacgcgtaaatggaggaacagctcggccagcattcaggcttttttctagctgtagcaatatatcttcgcgagtcacatttttaataatgtgtttgttggcccagccaaagcgcactgaactggggttgattaatggggtaatggtgcggtaggtattcagggttatcaggccatgtaagtgtgtgtgaacaaattcaaagcgttgttcgctgggtaagcctgattccacagtaataatatgttctaactcagcttttaactgattggttttttttattatatcttggcattcaatgagttctttgtcggtcacggagaagcagagcacgccaggtaagcgtagtgctgctttactgctaacatgctgcccttggtgatgaagaaataatcgttggaaatgttgtaaccccaaccttttggcgtgttcaccctcggttatattgacggtaatttgctcaatgggttgatgctcagtgcctttttctatttcagggagagaaaatactctggccgcaattagaggtaaatcgtccaattgctggtggagttgatgaagtgttacttctaactcagcaaagcgagtattcattcgttctatcaaatcatacttgttcatattcttttctaaacaaggcggcttagttacaacatacattatcttgttctcctaaagatagccacatgtagatacataaatgtcattagattcaaaaggacatataaaacagaaaagggcgcttaaaacgtgagaattcgcgactcaccctcatatgtttaccgagctcatttttcggtagcaagacacatagagagtggagtctcaacgcttggctgttcctaccaactttcgtaatcgctgagcgataaacaacgcgataactaaaagggcggtaataaaaacaacaacacctgtccagcctaaatgtaaccaaaaaacgccacctaacgtaccggctacgctggaaccggcatagtaacaaaacagataaagtgacgaagcttgtgccttagcacgacgtgctctgcaaccaacccagctactgacaacggagtgagcggcaaagaatcctgctgcaacgaacatcataccaataaaaatcatgatcactgacggaaaactggtgatcacaacaccaaccaacatcataccgatagaggccaataaaattaggcctcgcccgtagcgattactgagtgaacccgctttaggtgaactataagaacccgttaaataaacaatggataatagccctacgatggtcgggctgagataataaggcccatccagtaaccgatagccgatataattaaataaggtgacgaacccccccataatgagaaaaccttcagcaaatagtaggggtaagccggagtcacgccagtgcagtttaaaattgattaacaacgttctggggcgcaatgaacttgcacgaaagtgtttagacgctgggaggataaaccaaaacaagcaagcagcagctaaagcaaataatccgagtactagcagtgatacgcgccaggaaaagagatcgcttaataccccagccaccaaacgcccactcatgccaccaatagaactaccgctgatatacaaccccattgatagcgcaataaaattaggatggatctcttcactcaaataggtcattgccaccgcggcaactccgcttaaggatagaccggtcaatgcgcgcattagcaaaatcccatgccaactggtcataaaagagcaaactattgtgcaaaccgcggccaatagcaacgccacgaccatgactgattttcggcctatcgcatcagaaagggggccggtaaacatcaaacccaacgccagcatcccggtggctatcgaaagtgacaaactgctggacgcaggagaggtactaaagtcctgcgacaacatgggcaaaataggttgtacgcagtaaagcagggcgaaagttgctaaccccgccgaaaataaagccagagcaacgcggatgaattctggcgtaccttgttgtatataaggacgcttatttaggggaggcagtttagggatcgtagtgaaaacagtgtcatcatcattttttgttgatgctggcgccacagtgtttgtagtgtgtaatgaagtagtcacggtatagccttattaatacatagccaaattagtacacagttaaattaatatacagttaaattagtacacggttaaattagtacacggttaaattagtacacaagcaagttaactcacggaaaaattaatacacaataaatcattatcgacagaacattttaatcatagaaatagtttgtttttttgtctaatatattaatcattgcaaataatacgtttaaaatatcaatgagtattgaactaagacatttgcggtattttattgctgtcgcggaagagctgcactttggccgggcagctgaacgcttgcatatttctcaaccccccctgagccagcaaatccaaatccttgaagaacagattggggcccgcttattggcacgaaataagcgtaatatcagtctcacccaagcgggaaagctctttttaaaagagtcctaccaaattttggcacaggtcaactctgcaactgagaaagcagcctgtctacatcgtggggagtcgggagtgctgacgatcggtttcacttcatcggcaccattgatcaatgttgtttctaagaatttgcgtacttttcggcaaatatatccacaagtacatataaaaatgcaggaggtaagtaccaaacagcaaattgaagcattactcgacgggcggttagatctaggtattatgcgtaatactcggctgcctgaggcattacaatatcgattgctattacgtgaacctctggtcgctgtcgtccatgaagatcatccattagcctccctaccaaatggcagtgtcaaatttagctcactggacaaacaaccttttgtcttcttttcacgtgaagtggggactgcactttatgacgaattctttaccttattaacccgcgcggggatcacaccttatattacgcaggaggtcggcgaggcgatgaccatcataggcttggtatcatctggtctgggggtttcaatcctgcccgcctcgtttaggcgagtaaacgttgatggtgtcaaatacttatcactggacgaagctgatgcgacgacagaaatgtggttggttaatcataagcatcgtccgatgcccccccctgcagaagcattgctccgtttgatgatggctgatattcaagctgctccgtataaatagtcaccatattaaggaaaaaagaaaacacatgattatgtgcagcaaatcacataactaatcaaatagttgacgtcatataccaaaagccccaacataacgataatctttatttagaagcgcgaaaaatactcttttacaagagttaaagagtcatttaggcaaaaaaggagccggtttagtgataatggatggacagcctggacatattgatcagatcaaacaaaccaatgtaggggccgtttatcggctaattgatcttttggggccgatatcccgtattgaactctccaaacgggcccaattagcgcccgccagcatcactaaaattgtgcgagaattggtcgaagttcatctggtaaaagagactgaatatcaagatgtaggaagccgaggtagacctgctattgggttagtcttggataccgaggcttggcactatgtttccgggcgtatcagccgtggaacgataacactggcactgcgcgaccttagcagcaaactggtggttgaagaacaaattccgctgccagaccgcccccccgagccactgctgagccgtatccttaacgaggttgaccagttttttattcgccatcagaaaaaactcgaacggctcaccgcgattgctattacgatgccaggcatcatcgatgcacctgcgggtattgtgcataaaatgccattttatgatgttaatgaaatgtcacttgggccagcgttggagcaacgcaccggtttacctgtctatctgcagcatgatatttgcgcatggaccatggcagagtcgctatatggtgcctcacgcggttgccagaatatcattcaagtcgttattgaccataatgtcggggccggtgttatcacctctgggcgggtattacatgctgggagtcgcagtgtcgttaatattggccatactcaggttgacccctatggtaaacgctgctattgcggcaatcatggctgtttggaaaccgttgccagtatcgataatatgttggcgattgctcaacaacgattaaacagttcaatgagttcgctgttgcaccatacacctctcagtgttgagtcgctttgtgatgcggcgttagccggtgaccaattagccaaagatattattctgggtgtaggtcatagtgtcgggcgaattattgccattatggtcaatttatttaatccagagaaaattctggtcgggtcgccattgaataaagcatcatctattttgcacccggcaattgcctcttgtattcgtcaacaagcattgcccgcatatagcgagaatattcttgttgaatcaaccgaattttttaatcaaggtacaatgcctggcgcagcattagtcaaagaggcattatacaatggctcattattagtgaagttgcttcaaggctagtgtattaaatctaataattaagagttaattattagtgggtaccttcggtctattacgcctattatttggcattttctgttaaaaacacgctcagttcggcaaaacattgcgctaacgcaagctgtctgttgctgtcatcgcctagacttttattcatattgccaattccgccaacttcggtggaaaaacttgagttaaagtggtcagattgcggagtgttgttatgttaacgcgtttatttgtgacaggtaccgacactgctgttggtaaaaccgtcgtgtcacgggctttacttcaagccttaagccaaaatggcagaaccgcagtaggctataaacctgttgcgacagaaagcaaagagacctcggaagggttgcgtaatcaagatgcgttgatcttgcaggcgtcatcatccattgagttaaattatcaggaggtaaatccatatccattacaaggtgatgttattcatgcctgtacagataccctgattaattatgaaaagatgaccgaaggattgcagtgtttatcggctaaagcagataccgtaatcgttgaaggctgcggtgggtggaaggttatgatgaatgaccaacgcttttactctgactgggtggtacaagaacaattacccgttattttagtcgtcggaattaaattaggctgtatcaatcacgccttattaacagcacaggcaattattaatgatgggttgcccttattgggttgggttgccaatcgcattaatcctggcttggcccattatgctgaaacaatcgcaatgctacgggatcggttagccgcgccacaattagggcaactgccttatttgccgcgaccagaagaaaaaccattagcaaaatatttagatcttacagctatttcaggataacccgatttatatccatcctatttcaagctgaatgtgtgtttcaagctggaatgtgtgtttcaagctgaatgtatgttggctgctttcgttactcggcccatcatttagtgagaccgatataccgatattgggcgcaaccagcgggctattgttgtcgcgataacacaagataataatagccctggcaataaggtgtactcgccggtcatttcacaaaccattaaagcggccataatgggcgcatgggtcgttgctgccaataatgttgccatgccggtcagtgccattaataacccaatattgtcgcccagcacgggccacaaagaaaatatctgcccacataacatgccgagtgcggcaccgacaaacaatgtaggtgtaaatacccctcccggagcgccggacccactactggcaagcacggccaataacttacagatcaatatgccgcctatcagtaacacccccggcggcgtggtgaggagtgattgcactacgctgtagccattgccccagacctctggaaatatcaatgatagtaaaccaacaattatcccccccagcgccaattgcagaggtggcaataaattcagggagcggaaagcatgactgctagccgccatcgcttttaaaaataaagggccgctgaagcccgccattaatcctagaagcgccatcaggaaatattgtaccggccaaggagaagggagtgtctgcacttgataaagggtttcctgaccaccttgtagcaagttggtcgtcaataacgcactgaccgcggcgatcactaccgggccgagtgaagccaacatcagtgttccaaatagaatttctgcaataaacaggctgccagccaacggagcatggtaagcacttgccattcccgcagcggccccacaggcgacccacaacttccactctttaggttttgcatagcgttgagcgaaaaccgaagcgaacagggcggccaacaataccatagcgccttcacgaccaatggcactgccgctggatacgactaacaaagaggcgagggacttcactaggctggcggaaacatctaatcggccatcaccgatttcaatggcttccatataatcagtgggcgcactgggtttacggtgttgataacgttggtatgcccataacagcaaacctgccgccaatccccccaaagcaggagttaatgcccgccgccacccagtaatagaggccgcagcagcaaccaggctaccatctgttcgtgagaagagcagccactccagccccagcatcgcctgatgaaacagccaaacgatgagcgcggataccatgccgagcatgatggagatcactaatcgacgcagcatcgcacggtagtaatagagatggattggccgtttcatgcaagacaactgactgacatgttgaagtaaactctgttcttttagataaggacattgttacttgctagcaaatgaatggccagtaaatattgttcaatataaaaggcgtaccacgatgctacgccttagcagggagggaaataggttactcgctatcggtgatgcgggtataaacaattttctgtgaatcattctcacaatgcccaaccacttgaccaccggcttgttgaacctgatcgttaggaacaatttccagcttaaaaccggattccggcacgccattgctaataatcttttgtgcgatttctgcctttacactttcgcaagatgccagtgcagctaaaggggccagagagaataataacgtactaataataagtgtttttttcatcataaatccttatgggggtgaacagttcgcctgatctattctattttttcctaaatagtttttaaataatagccaaggttcactgaacttcaagtaaaccttaaccatattgagtcatttacggattaatctgacagtcgggcattctgttttttattcacgggatgatgagggaaaagttgaaattgtttataaattatataaacaacgccattacggattaattttacggccagataaacgatccaggcaacgctgagtattaggttcccaataagcgtttagattatcgctacgctcacaattatctttcgcatcgactgcccgatcatttttatcaaagtccttttcgacccgattattcatcttgttacgtaagcgatttgtttcatcccactgttgctgactttggcgcgcttgctcttttgacatgggatcattgttgccaccgacagaaacacaagtactgccctgagtacaacttgcagattgtgccaaggcgggtgtttgccatactaatggcaacatcagcagggttgctggcaaaaaagtacgtatcaggcgaggcaggttgttaattttcatcatttaagtcctttttactggtcggtagtcatcatcatgtaatttattggcacgctatcagcgaatagaaattatatcattgcacccgatatataacactgtgccagcaacatacactaggccatccacatacactaggccagcagcaacctggtttaaagtatgtaaagtaactcgacgttacggctaaatcagtgcagggcggcgactgccacccaataagccggttttaggaaccgcgatgaatattcagcccagcaaaagactgacttactggcatcatttccaatgagttaatattgacgcgggcagggagcgttgcaacccaataaacagcttcagcgatatcttctggcatcaggggatctgcaccatcgtaggttttattgaccttttctccatcacctttaaaacgaaccgctgaaaactcagtaccgccgaccaggccgggctcaatatcggtaacacggatatgagtgccatgtaggtcggcacgtaaacccaaactaaattgtttaacaaacgcttttgtcgcgccgtacacatttccccccgcgtatggccaattagccgcggtagagccaatattaataatgtgtcccacattacgttcaaccatcgcaggtaataaggctcgagtcatatttaccaaccctttggtattggtatcaatcattgtatcccaatcatcaacgttggctttatgtgctggctctaatcccaatgccaacccggcgttgtttaccaataagtcgatattcctcagctcagcgggtaattcatcaataacttgttgaatagctgcgcgattacgcacgtccagacgtacgatgtgcagttgtgcacccagttcggcttgtagcgcttccagacgttcctgacggcggccggcggcaatgacctgatgaccgtggctaataaatttacgggcaatcgcctcaccaaaacctgatgtcgcaccagtgacgaatatgatcatagagattccttaatttgttgttaccaataatctaattgatatcattaacatattctgagtcagagtggaatccatcacttaggtatcggcttgccgctagggaatatactattttactggcgtttttctcgcgcggcacggcggtatagcgtactgcgtgctatgcccaaagccttggcagttttactgatgttaccgttaaaatattgcagtgttttctcaataaactgcttgtcatgctgttgcagcgcggggtacggttcactattctcacctcggaagttgtcaggcagtgtctcgcaatcaagaacctcatcgtcatccgccagggcgaataataccttcagtaaactttgcagttgacgcacattacccggccagggatgtttcgccagcgtatcaagcagtgctggcgtaaagcgaatgccccgttgctcaccgcccaacgccctccatagctgtaaaataaaggcgggcagcgcgggccattcacgcagtggcggaatggttagagagaactcttgcaatcggtagaggaggtcttcacggaacccaccctccgcgaccaactggggaagatcccgatgcgtagcacagaccaccgcaaaattgactggccaactacggctagaacccagcggcgtcacctctttttcttgcaatactcggagtaagcgggtttgtagcgataacggcatatcgcctatttcatccagaaacagtacgccaccgtctgcctcccgaattttgccaatatagccatttttgctggcccccgtaaatgcacccggttggtatccgaagagttctgattcaatcagagactctggtatggcagcgcagttgataacaacaaacttaccttgccgccaccggctctgctgatgtaaagcccggctaacatactccttaccactgccagtctcaccatttatacaaagcgagacgccagcattgagtaatcgcaccattttcttatcgtcatcgcgcagtgagaaggataagtcaggcgaagttaccgatgttgtgggaacgtgtattattgcagggaagtggcttcgtgctggcgcccgtaggcgaaagaaataacgttgttgattgcgagccattaaagggtgcggcacctgattggcaacttgcttactttgcggaaaaagttgctggaaggttagggcaccaaactggtcggcccccaacgccaactcgtgcatcgccagacggttagctgccatcagagtgttatcagagaacaccagtagtagctcttcaatattatcaatgccttgtatttgtggatgcagactcatcagccactgatctggatgcaggctctgtttcacccataaatactcaatttgtttcgccgcgttttttatccatgccagtgtgtggggatgggagtgatacgccggacccgatatatccagcacaccggcaatctgtccgttaggcgcttgcagtggcatagccgcgcagtaaagcccctgattgttaataagataatgctgatgcccatagatttcgcagctatcatcaatcgccagggcagtaccaatggcattcgttcctcggctgcattcactccatagattaccgggcgtcagggcaaactgttgtgctttttgtagagcctgtatatcgccgaaggtattcaataccaatccactggcatcggcgaggaccactaccgattgcttatcggcaattttctcagccagcgctttcactgttggctgagaaaattgctgtaatacggcgtgactgaccagcaagtcggccagttctccctgctcaatacggggaacatcgtcggacatgcgatctaaaccgtagagttggctacgcagccaagagtcacggagtcgttgattgcacgccgtagtgggcgtgctggcggctgataaatttccctgcattggtaatttcacaccttcgctacacatgtatcattattgtgtctcaataatgattttaatgttgcgatttgcaacgcaaatattaaccccttctctatttacctctaaaaacaaaattaatttatcataacaaattgataataaatgaaatttatatatcaactaaaatcaattaattggcacgataactgcttgtattggaaagagagcaaacgcaatcgaaacatatcgataacaagataacagcgacggttgccgacctctgataataaacatcctacataaggagcttgcaatgcgttatgcacatccaggaacaccagaagctttagtctctttcaaagcaacctatggcaactatattggtggggaattcgttgaaccgctcggcggtcagtactttatgaatacttcgccagtgaatggcagtgatattgcgcagttcccacgttccgacgcccgagacatcgacgcagcgttagatgccgcccatcgagccgctgacgcttgggggaaaaccagtgttcaacatcgttccaacctcctgctacaaatggctgatcgtatcgaagccaatcttgaataccttgccgtggcagaaagttgggataacggaaagccgattcgtgaaacactgaacgccgacctgccacttgcggtggatcatttccgctattttgccgggtgcctgcgggcacaggaaggcggtgtggcagaaattgatgagaagaccgttgcctaccactttcatgaaccgctaggtgtggtagggcaaattatcccatggaacttcccgctgctaatggccgcgtggaaactcgcgcccgcactggctgcgggtaactgtgtggtcctgaaaccagcagagcagacaccactgggaataacactgttactggagttagtcggtgatctcttcccagcaggtgtgctcaatgtagttcagggctacggccgtgaagcaggagaagcgttggcgagtagtaaacgtattgccaaaattgcttttactggctcaacgccggtgggtcgccacatcatggcttgtgctgcggagaatattattccctgtactgtcgaactgggtggcaagtcaccgaacatctattttgccgatgtgatggaggcagaacccgagttcattgagaaagcggttgaaggactcgtcttgggcttcttcaatcagggagaagtttgtacctgtccttctcgtgcgctgatccatgaatcgatttacgcaccatttatggcgcgagtcatggcaaaggtcgccaatattcgccgtggcgatccactagataccgaaaccatgattggtgctcaggcttcccgtcaacagtttgacaaaatcctttcctatattgacatcgcccgtaaagaagggggggaaatcctcacggggggcgcacgggcaactatgacacctgcgctggatgccggtttctacatccagccgacattgattaaaggtgataatctgatgcgctgcttccaagaagaaatttttggcccagtaatcggtgtaaccacgtttaaagatgaagctgaagcactggctattgcaaatcagacgcaatttggccttggtgcgggtatctggacgcgtgatacccatctggcttatcgcatgggtagaggcattaaagcgggtcgtgtctggacgaactgctatcatgtctatcctgcgcatgctgcatttggcggctataaacagtcgggcgtagggcgtgaaacacataaaatggcattgaaccagtatcaacaaacgaagaacttgttggtcagctatgacaccgcgcctttagggttgttttgagtctatcaatattttgagtctatcaataaattgttcagcccactgggtgccaagattgcagcgccataacggtggttaaatgaagagtaacgtttcaaagaccggttattagtgaccggtcttttaaggggtctgaagcccaatcgtacggaaaggtacgctaagtacatttttcgcactatcactagtcactcacaccgttcagtagttttagcggctcaaaattactgccactggacttacaatccatctggcagacattcagtccagaaccgctggctcacattagacgccacttttctatcatctcaggggaaccgtggaactcgacatcatgcactcgggggctcaggtcaaggtcggggtgttgcgcctgtagcgcaaccagtgtttctttgtgtgcattcaggtaactccccacctgctctctgccttccgggcaatacttttctgcggatgcatgtatccgctcgaatagatccggttggttaacccctgccagattagtgggcacataaggacggttggcggcagcggcctcagcgatagggaaagtctcagcaaaggtgtgatagccgccgaagttcatgaaagcagctatccccaagcccgcgggcagagccaggtcagggttgccgtaaatccgttctccgcccagggtgttgagtgccagtaagatatcgcaggtgccgccagattgcgcgccggcggaaggaaggccctgctgattgctttctaacgcaaacgtaccaaacggctgccagcggttgataccggtgccgtgcgtcatcgagtgctgctccagcatctgagccatgccaagctgagcataggcctccggaaccgcccccatatcctcctcggacatggtgaacgggcggctcagatcggcgatcggcgcacctgaacgcgctatcgcgttaatgttttggtttcggtcgcccaaggcctgacgcaaagccgcatcgtccgcgccgccgacagtgcgctgtaccacctgaccaaagcctagtccatatttggctgcgtcctcgtatatcccgttcaccgcgcgcgcgccgtcttcgtcggtcgtcaccataggcatgcgctcgctgcgtgcgcgactcaatggattgtcgaaacctggtgtgcgggttttgccggagaattccttgaagcgagcgtcgaaatcgtccgcctgcgaggacagaccgacttcgcgtagtagcgcagcgcaagcgtcggcattggcttgtttatgctgagagtacagttccggcttggcctggttttctaccgggtttatcaactgccacaccgtggtaccgaacgcgctcaaggtgcgaatcttggtcaacagttctgggtacccttgcttgagggaaccatcggcgaggccttgcaacggtgtgttcagggtgtccaatatccagggctgaaaatcctggatactgtccatctgccggcctatctggtcggactccctcgacagcggtttgattgctgcctgaagtaccgcacccagtgtttgttgccggccctgaaagtgaacggtatggttggcggcttcactctgtccgtccagtatgtgacgcaacagtcccgctaattgttttgcgtactggtcgaatacatggcccattttgcctggctggtctagaagcgacatgctggcacctgcctcgaagaacttgctgttattaactgccagtttctgagcgtcggacaaggttactccttgtgggtcactcttggatgttgcttccggcttaccttgctcattcatgccgaaaatagcgtttagagtactgtctgatctagatacaaacatgggtaaccttattgtggagagattcaagtcacttctataccatgggctgtaatttgaaactttcataaaataactattgtattaaaagtgttaatgcagcagggctgctgactggaatttagggtgattccaaaatgggaatagtacgttttcgtacggttgggcttcagaccccttgaagaaagaagggaagggtaatggcgacatattcattccctatacgcaaaaatagttcatcccacaaatagtcaaaatccccaatagacgcgctgaactggctattcccgcaatcataatgacgcttatcagcctcagtgagttaaaaaacatccatcttgatatcaccatgtgacattccaatacatattaagcagagttattcttaagcagagttattcgtaattccataagaaacaaatgatatataaatgaaacaaataaaaacataatattaaaaaatgaaacaccgatttttcacacccttgttaaaagagaaaataattctcctaaaccataaaaaatacatgcataagaaaatatttttctcatattaaagatatatattggtttcgtctgtaggggaggatttatgcgcaaggtcataatatcaatgctatttatattagtttctttaacctggggcacaacatggttggcaatgagaattgctgttgaaacaattccacctatatttgccacggggatgcgctttatatttgcatcgccttttttaatctgcattgcattgctaaccaaaacaccacttttatttccaactgggcagcgattttttcaatttataatctgtatattttatttctctatcccttttacgttaatgatttatggtgagacttatgttagttcaggtcttgcctcaattattttttccaatatgccagtggcagtattaatcgcatcggttatcattttaaatgaaaagactaatttaatgcaaatcacagggttaactattgcaatggtttctctggcaagtatcctccttgaggagtcaaaaacaggtgttgggagtcattggcaggggattctagctcttgtttccgctgtgattatacatgcgattgtatatgcgcaatgcaagaaaaggtgctgcaccgtctctgttatcacatttaatgcacttccttgtttttgggcgggtttaattcttgcatttgcagggtatttttttgagaagccacaacttgcgaatttctcaattaattcaatgctatcaactttttaccttggcgcttttgctggagtatttggcattttgtgctattttctgctccaacaaaaggccaatgcttttcaggcctctcttgtatttttaatattccctctgattgccgtaagtttggagagctatatctatggatatgcaatttcattttactcaatgctgttgataatacctttagcttttggaatactcattattcttatctctaagaactattatgcagtaaagaatcagggtagcgttacaccggtagatatagagaaataactattagcgtaggtaagtcagcaaaagttgaagcgcagccaacagataaaacaggaccagttttgggcaaaggtgggccagcgtttatcgggcatagtgaagatgacgtactgccattcacagtcggggggaatatgctattgctcggagaccttcatattaccgtagaattcatccggccggtgtcatcgcaggcgtttttgccacgtcttaactggtgaggtacaacatggccatccgctcagcataatcacttacagactgcaattgcgatgattgcggtaatagagcaaaacaccggcgttatcgcatcagcccaatcatgaccacaaagtcccagatttcgcctatcgtcaccttggtgcgcataatgtatattatgttaaattgaaatcatggcgctaaaaactcagccgatatatgtcgtgaagctaactacgatacggcctgtatcggtatcctctcatcaagcctcaaaaatcaatatgtaagagatggatatgcagatgcaggattaatccccttccctcatttgagcccggtgacgctatgtgaaatcgctaggggtatcaatcgccatttccatgccattagaactaccgatcatgaacgttaggaatggatcaatatcggagcccaaggttctgggcccctccatgatatttagatattggagactgtaaacgagattgtgtaatttccctggtgtggcatttaatataacgtaaggttccgatttatattggtcttggccattaccggataccttttgacttcaagtattcatttcataggtgcaattatttcataggtgcaattgtgacaacccttcaattgcattttctagataacgacgcggacatcctaaatttattcgaataaagccagaccccatcggcccgaaactttcacccatggaggcggcgatcttcgccttctcgagtaaagcttgcttcagcgttgcatcatccagccccaagtcacggcaatccagccaggcgagataagtgccctctgccttgaccatgtgacaccaaggagctgcatacgctaatgcctgttcaagccagcgccggttctcggctaaatagacctgtaaggcatccatccacggtgcaccgtatttatatgctgccgtagctgcagtcatagataaggcattaaatacatctaagccatgtgcattaagccgattgacaaaggcatggcgaatatctgggttaggaatgagaaagtttgaaattctcaatgaagataacccaaatgtcttacttgccgatgttgccgcgataacatgctcatgccattcaggacctaaatgtaacaccgatgtgaatgtctcacctggcaacgttaagtcagcccaaatctcatctgaaatcacgataacattgtactttttgcacagtgccaatagctgggtaagctcttctgaccgccagcatctacctgtaggattgtgcgggttacacagcagtaataaccggggtttctcacgctgaagcagttgttctaaatggtcataatcaattttataaccctctaggctctcaacgagtgggttctctaaaaccaccctattattcatcgtgataatcttggcgaatgaaccataatacggtccctgaatgacaaccccatcaccaggttcgctcaacatttgaatcaacaaagccagaccggggacgacgccctcaacggaggtaaaccaatctcgattgagcgctaactgatgccgattggcaaaccaattaatcgcggcttgatagtaatcatcatttctttcgctatagccgaatacaccgtgatcaacacgggtatgtagtgcctgtagcacttcatcggggcatctaaaatcaaaatcagatacccacataggcaataaatctgactggtctagctgtaagtattgatttaaaaaatcccatttaaccgaactggtattatgacgatcaatgacttcgctaaaattaggctgtttcatgttgcacctcctgacgctgacctgcactctcaggttttactttggctataccaaaaccggtaaaaccataaagaagggcaaagaatacagcggcataacactgaacagcccacggtaacagatccaaagtactgactcccagcgttgtcgccatgtagatccctgcggcggtccatgggatcaaaggctcaataacggtaccggcatcttcgacagtccttgatagatttttattatccaaacccattcggccataagcgtctttgaacaattctgcggggattagcagcgctaacttcccatcactggtggcacccgtcactaaaattgtggttgcgaccgttgcagcaataagttgcccaaccgtgcgtacaaccttcagcaagcggttgataatgaccgtcagtgcgcctgtcagagtcaatgcacccgcaaatgagaatgcacagaagaccaaaaggatggtactcatcattgagaacataccaccacggttcaacagacgaggaacgtcactgacaataccggtttgcagcccttctggccattcgctcaatcgggtaatggacggtagttaatgatggatagagatagcgggccaatacgacatcatcaaaaccaacaattgaaagttgttctggcaggctgatgtttctttgatgtaatgaccgcatcatcccggcagccatcacatcgttaaatgtcaccactgcggtaaagttctgatcactggctaatagtttctctgccgctaattcgcccccctcctcatcaaacggaacactaataatccaatcagcaggcaccgtgatccccgcgctggccatggcggctcggtacccttccaagcgctgttttttgtcatcaatcgataacttggctgtgacacaggcaattcgggtatgaccattctgaagtagataatgggtggaggcttctgcggcacgggtattgtctaaccagacacaccggttagcgatagcgggtaaataacgattaatgagtaccagcccaggagtgtgagcagcatagcgcaagatttcagcctcgctcattcgtgtgatgtgcgcaacgatggcttcgcatccttgattgatcaaaaaatcgagccctgctttttccagttcttcctgatggcccccactgcagaccatcaattttgctccttttttacgagcaacctcttcaacccctcgggctaaacgagagaagaatggatcagccagattaccggtaagtaagcccagcatgtttccacttcttttagccaacgcgagagctgccgcatttcgctggtagttgtactcacgcattgccttctctacacgttcacgggtacctggctctacataggccgtattattaagaacacgactgaccgttgctactgaaaccccagccctcagcgcaacatctttcattgtggccacacgtcactccccatttaggcactctctttagctgttttataaccaccgaacatcgatagcaactcatgtcaccacaacaccattgaatgtatgtgtacagcactggcatgtcatcggaatatcttctgcactcagtgatggattcaccttttgcaatatacctgcgtcatcaacatataagccatgataaaaacgggtatcgccacaacggacatagtcgcgctgttcatgtgagtgcaatgcgaccatccaaaaaatcggctcaggtttatcaaggcgtttcaccgcatgactgtatacctcatcccattgctggcccactttagtcagcagaaacataaacagcggggagtaatccaagcctcgtttctgcttaccatgcattgatgcacgctgtggcatgttctcatctgttgctttctgtttataccgttcccaacgatattctgcgcctgggttgtttgagcggtgacgtgtggtggtgttaactcttcgatatagctttttagcggtattttcctgatgtatgcgcatcaatggtaatccattacttttagctgattagacataaaataaaacctttggcgctggtgataacccgcctcctcagtctcaataatgattaaatgacaccgctgactcactggtttggctcatcagcggtgagagataataacttactctgacatcacaaacggtgatgtatatttgtcgacattcgcttttgtgatcaacatacagtcaaaaagttgtttttcaccccgagcgcccgttttaccggttttgaggaaattatccgcctgttcaatggcttttgctgaaaaaacagcgaccggttgcaacacagtataagccaacgtaccggctttcacggcatccaccgcatctggtgaaccatcaaacgcccctactttcacttggtcgattttgccggcttccttcaacgcggcaatggccccgagcgccatttcatcattcccgctgataaccccttttatgtccggatttgcctgaagcattgactgcattttgttgtatccctgagtacgatcccagttagccacttctttaccgacccgtttgaggtctggatactgagacagtacgctactgtagccgttggcccgggtggcggcgttgttatctgacggcgcaccaaccagttcaacatatttgccggagtctcctactgttttaacccactgtatggcacccagcgcggcaccctgagcattgttggagaccagttgtgctttggcaaggccgctttggttgagttcagcgttaattataaataccgggatattggcggcgatggctttttttaccgaacctattgagccgtcagcattggccggatcaagaataatcgcttttgatttgttggttatcgccgtatcaataagctggctttcggtattggtatcacctttatgggcactcacggtagcgctgtaccccattttctctgccgtggcttttgccaccagcccctcggtgaaccaatacgggttagagggatcgttgatgatgatcgtcattaacccattattggcccacgacgcggtggaaaaaacagtggcaaacgtcatggcgacaaggagaaggaaatgcttgctgttaaacataatgaatactccactttatgcaggatttagggcgtgtagatgacgcgattttttgatgacctcaacgtaaatgacattaattcggcgtaaatgacattaattcggcgtaaatggcattaattcgacgtaaatgacattaattcgacgtaaacgacatcaatagcagggactgcccattctccccacctgcgcttataggttttatagatgcacttgttttatttacttcgtcggccgtactgcaacgtattgagcaataccgccataacaatcaccgcaccagtaaatacggtctgccaataggcggatacgccaataatcaccaagccatcggaaagaaagccaataacaaaagccccaagtagtgtgcctcgaacgttgccacgccctccggtcagcgccgcaccgccaatcaccaccgccgcaatggcggtcaactcatacgtggtgcccgctgtcgggcctgcggaggttaactgcgaagagagcaccaacccggccagtgccgcacaaaccccggagagaacataaacgctgattttgacgaatttaaccggaacacccgagagatccgcggcacgctcattgcctcccgaggcatacaaccagcgaccaaatgcggtacgcatcagtaaaaatccacaggccagtgccacgacgcccagagccagcacgccaatcggaatattaaagaggcgattaaatcccaaccagtcaaaaccggtattacctagctcggggctacccgcgagtttgttgtaggttaagccattggtcatcagcagtgccgcgccacgtgctacatagagtgaaccgagtgttgccacaaaagcaggtacccgaaaaatggcgatcaagatgccattgataagcccaaccaatgcgcccagcgccagggtcataattaccaccgcccagaccggcaaataaagcactacgccaagtgactcaatgctgatgccttgcattaaaaaacccgcgaatacgccagacagacccaatgtcgaaccaacagaaagatcgattccaccattaagaataaccagtagcattccaatcgccgggaggccaaatatcgccacatgtgaggccatcgtcaggaaatttgcgccagaaaagtagttgggtgagaggagtgaaaacacggcaataatgaccaataatgcaaagaaggcgcgcccttccagtaataagcgcgaaagcttcagataacgcggcttatcagcgcttttggccggtgtagagcgtgccgtatgcagcatttgggttctctcgttcatatttttcggctccatgtagggtgatgtcaggcaatcacggactcgccagaagcggccatgatgcgttctttagaaaccgcagaatcaaagatggcggtaatatgccctttactcatcaccacaatgcggtgcgctatactcaggcactctcctacttcggaggtggagtaaataacggccagtccttttcgggcgctctcagcaagtaaacggaaaacctccgctttggcaccaatatcaatgccacggctgggttcatccaataaaatgacttttggccgggtcgccagtatcttgccgatcacgaccttttgctgattcccgccggatagtgaccctatcgttgcctcaccccctgtcgttttcaccgtcacattgcgaatggagtcaaccaccaattcctgttcacgacggggagaaagcaccaagcggcgaacaaactcgcgaatactggccagtgtgaggttttccccgactgacatcgtctgcaccaagccgtcgcgttgacgatcttcgggtaccaacgccaaaccgctttcaatacggtcagcaatgctgaggggggaaatatcttggttgttgagcaggatactgccgcgctcagcgctaagccgcccggcgatgcactccatcagttcagtacggcccgcgcccatcaacccgtaaatgcaaatgatctccccggcccgcacacttaatgaaaggttatccacggccatataaccgctcgggccgggaacgctgagctgatcaaccgccagcgcgacatcaccaaactcgtagccctgcggcggtgaacctaagtcaaaatggtcacccaccatattgtgaacaatccactccagatcgatatcactgcgctggccactggcggtcaccaccccatcgcgcaataccacggcgtgatcggtgatttccagtgcttcctccaaatgatgtgagatatagacaatcgaaacgccccgctgggtcaagtcacggataatgctgaacagcacgccgacttccgaggcactgagtgctgatgttggttcatccataatcaaaatacgcgccttaaccgatagcgcacgggcaatctccacaatctgttgctgacctaagcgcaaatcttctacccgcgtcaatggatcgatatcttcctcaagttcacgcatgagatcccgggtaatgcgctcttcattggcaaaatctactcctgaaacagtcatcatttctcggccaataaagatgttatcgcgcacattcatgttgggggcgagattcagctcctgatgaataatggcaatcccatgctgacgcgcctgggctgtcgaggtgaagtttttcacttcaccattgagtaaaatatcaccggaggaaggcgtgaccacaccggagagaattttcattaacgtcgattttcccgcgccattttccccaaatagtgtggtcaccttaccgcgacgaatatcgaagttcacaccttgtaaggcgtgggtcgaaccgtaaattttgctgatattccgcgccgctaacacgacattgggatcatcctgctgttcgttatctgtttcttgggtcattgaatatcgatccttaccggtgtgaccaaccagttatctgggttgagtaagctaaatacaccaacgaccttcacggttttaccggtaagcgccgcagtatccagcgcttccagcaccgatgatttcatcgcgctattaattgccgctcctgcattctggtattcaatttgatttttaaagtcaccaaactgtattttgcccgtcgcatcacgcaaagcggtgcccgtgatcgcagggccagtttgtattcgcacctgcatctcatccggtaaccaattgatttttaaattgtaaatccccatattgccgtcaccgactacaccggtgaaatagacagcgaataccgccaacggtgagccaacaccatatttttccacggcttgttgcgagttggttcgcagtaaatccgccagcatgagggcatctaccgcttgggccacgacacttttttgaatttcagggaagatactcacaccatagctttttgcagaaaaaacctgttcccgaacatcctcagtggaacccattttcaccactttagtattcagggcaataccactcagaatcactaagacagccgcacaagagaacataatgcgttttttagtacggctggcgaactgtgaagaaagttcagacacattgctcatgctcttgcctcatatagcctatcgcccatcacgacagtaatcgcagtcatcgccgggtttatcaatcatgaaatcacacatgttcacattgatatcatttgaacgcaccacaatgtttgaaaaataggttttaacgaacaaaagttcaatgatatttattgtgaacatagacttgaaaccaataaatgttccataaatgagaaaaatgtcacgtttttgttaaaaaaacacctactcagggctttattacgtctaatacactgcgttactcgaaccgtccgagtaacagccattatcgacaaatgttttttatttgatcatatggatagttttgtttaataaatgcagataggtcttaataaatgtagataggtcgaggtgtgaagggtaaaggcgtgaaaggtcgatatgtgatagcggtcaaggaagtgtgattttcatacataatatgtatgttttgatgctaattaaaggtaagaataatgttggtttaatgttaacttttgtttctgtagtaaacgccaaggtattgtaatggactcattcatcacaccttggtgaatttcgagttatatacctgccctatttcaagttacatgtgcgttggctgctttcgttcactccagtccgccttcctgtgattcgaattattgtgggtatatgtctctgcaataagtcattattaataaattaaacttaagaatagtaaatgacatgaagcgattacaatcgtttcacatataagggaaaatatatgattaagtttatatcaacatcaataatatcacttgaattttataaaacttcattaaaaaaatcattcatagcaatatctgccttaccattactcatgtccagcatggcatgggcacagccagatgtggtaaggcttggtaatttaaaattcgctcattatggcgctatttcatatatgaaagagatagcaccaaaatataacataaagatagaagaacgaatgtttgcaaaggggatagatattgctcccgcaatcgtcgcggggcaaattgatatagcggccagtgcagttgatgcggcaatcgctgcccgcgctcaaaatatccccatctatgttattgccggatttgccaaaggcggtgcccgaattgttattggcaataatagcagtattaaatccgttgctgattttaaaggtaaaaaagtgggggttgcccgtggtggtgctcaggaacttcttcttctggcagagttggataaatatgggctgacatggtctgatcggccaggaaaagatgttcagattatttatatggcttatgccgatcttaatcaggctcttcagtctggtaatctggatgctattagccaatctgaaccgcatgccagccaggcaattaatatagggtatggtgtcgagttgttgaagccctacgatacccccgtaggcgttccaattcgcgcgttgatcatgacggaagccatgtataaagagaagccagaggtggctgctcgcgtacttaaactgtttgttgacgcgaccaatacctttattcaacaacctgaaatagcggaagaatatgtccgtaaagagatgttcaagaaccaaattacctcgcaagattatcaagatgctattggtaattccccattcagttacgacatcacggtggaacatgttcaggtgacgactgacttaatgcggaaatatggcatcggccgaatgaataatccccccgttgccgctgattgggtaaagactgatcttcttgaggctgcaaagaaaagcattggggttaatgggtcataactgatgaaaaatattaaggtttatcaatatatcaagtgggtcattatgccaactattgtgctgttaatgtggcaaatgctcgcaatatcgggctggatacaacccacaatacttccatcaccagtagccgttgtggtgcgctggttcgattatttcttaccctatgaagcctataacccagaaacatcaaactggctgatgtggagtctttcaggggagttactgcatgatgcctgggcgagtatctaccgcgtaattattggttttctaatcggtgctcttcttgctctaccattaggattatgggtgggttccagtaaaattggcaatgacctaatgaaccctttaattcagtttcttcgccccattccgccaattgcatatattccattagcgatgctgtggttcggcctggggaatccgccggcattttttttgataagtataggggcttttttcccaatactgattaataccatcgcgggggtccgtaatgtggatggcatatatatcctggctgcacgcaatctaggcgcaggtcaagccacgatgtttcgccgaattattcttccggcggccactccttatattcttacagggatgcgagttggtatagggaccgcgtttatttgcgtgattgtggcagaaatgatcgccgttaatagcggtgttggctaccgaattctggaagcgcgcgaatatatgtggtccgataaagtaatagcaggcatgttcacaattggttttcttggcctggtcattgatttatgcatggatcgcctgaatcggcgtcttttacgctggcacagaggaataggcaactgagatacccatatgaaaatatcagataatattattgaacaagtagagacgtgtgaaattagtattaatcatgttgataagtcatttggctctggggagagtattgtcatcgcactaaaagaaataaatcttcatatttcacatggtgaatttgtctgtttactggggccatcaggatgcggtaaatcaacgttactcaatgctatcgccggtttttctctgccaacgcagggggaaattatcgttaaaggtcacgtcgttactgaacccggtaccgatagaggaatggtgtttcaagaatatgcgctgtttccatggatgaatgtggagaaaaatatagcattcggcatggacattaaaggagagtcaaaagaaaaatgccagtctgtcgttgaagatttactgaatacactgggtttaagtgagtttcgcacacggtacccaaaagatttgtcgggggggatgcgacaacgtgttgccatagcgcggattttagcgctcgatccccctatcatgctgatggacgaacctttcggtgcgctggatgcattaacacggcgctcattacaggatgagttgttacgaatatgggagaaaagccgtaaaaccatcatctttgtcactcactcggttgaggaagctatctatcttggcacaagagttgtggtactcacctaccgtccgggcaccttgaagcaagatattactcttgaaatacctcgcccgcgtgataccagcggggctgaattcaacagaataaagcgtgaattaggggcgttagtgatggaggaacaacagcgattctccgctgccgaacgcaaaggcggttagcaaaacacagcgaagcgtaaatttaccgtccgtacgcagcgggttaatagcaagcacggcaggcggttacagccaccccctttcttatcgatactcacgctggcgataaacacccaagaatataatttcaagaattgtgccccaagaagagatatattagccagtatgttgttcgaaaatagactcggtagcgggaatacgttgagataatcactgaggccaaatgaaaatattcattcttatcgtcgttacgttatttctggtagcctgcacttctacagggcatatcggtatcagtggcggttcgagcggcatatccggtgtcaggataggcaccggcattcgctgattaatgtaagctctctcaattcaatacgcaggcggtgatcatcatccgcctgcgttgtttttcaatctattctttttaacggaacggtggctcattaaaggtacgtaatttacgagagtgtaattggtcaccttctgcccgtagcaaatcgattgcccgaataccaatctgcaaatgctcagaaatagcaccctcataaaaatggttggcctgccccggcagtttaatttcgccatgtaatggcttgtcggaaacacaaagcaaggtcccgtaaggcacccggaagcgatagccttgagcagcgatagtggcgctttccatatcaacagccaccgcgcgacttaaactaaaacgtagcgatgaggcggagaaacgtaattcccagttacgatcatcagaggtaacgacagtcccggtgcgcagacgttgttttacctcaacgcctggcataccactaacggctttggtcgcgtcgtacaaggcgcgttgtatctcggcaatgctagggatcggaatatcgggcggtaataccgcatccagaacatggtcatcacgcaagtacgcatgtgccagcacataatcaccaatggattggctttctcgcaggccaccacagtggccaatcatcaaccaaacatgtggcctcaataccgccaagtggtcacaaattgttttggcattggaggggccgacaccaatattaaccaatgtgatgccctgcccatttttggctatcaggtgataggctggcatctgatgttttttccacgccaggtcagaaagggttttttccggatcggcattctctgccgtgatgtaactaccgcctgcgcaggagagtgctttataggggctgtttggatccaaaatttgctcacccgcccaacggacaaattcatcaacataacggctgtaattggtaaaaagaatatacggttgaatgtcttcggctggcgtaccggtatagtgttttaaccgtgcgagggaaaaatcagtgcgcagcgcatcaaagtgagacaacggtagatcacttactgcgctgccaagtgatgccgtgccaagcgctatcgtttcaattccgtcggtgatgccatcaccgattttagccagatctgtcgtcgggaagtgctgggcaaggcctgcggtcattgaccgatcaaggatcaggtctgaaccatcgataacaaacggataaggcatctcttgttgtgacggtgtcacttcaaataccgcgccatactcactttcaagcagcgtcatttgctcggtcagatattccctgaacagtgcgggtcgagtgattgtggtgctgtattgccctgcccgggaaaagcgcccgtatgcacgcgtgcggtgatgatcgctaaatttaccatcccatcggacactaagctgtgggtagctaaataaccccttggatctttccgctgcattaggcaaagaaccatcacgaataaatgcgctgatcgcatcccgtaaagcggctaacgctgcatcatagagcatttccagcttatcaatggcctcaacaactgcgagagagcctgtatcttgtaatttattcaaagtacctcctttaaacacaagagcagcgattattgaccaacacagtgctatttattgcgcagcaaatccagccttttcctgaaaacaggaggaccttttgccgcttattcaaacgtttgattcccctttatcaacactaaaatagtcgctgtcgcagataacacattattttctgccttgagcatcactaaaaggtcttttttgcgtggcaaaatcatttttacgcagtggaagtttggacgatattctggcgttaggtgagaacgggcaaccgatttatacctctgcacttcagatcagagaagctttacgccttaaaaaacagcaatatattgttgattgcttggcgatcccccagatcaacgaacaaggtaatcgcattgattggtatgctcccttcgaggggaaagtcacctcatggattgccgcctcgagtacagaacgcaaagccgcggtgaaacaattagccatctgtctggccagtgctagcgatatcagcttgcgggctaaaaaatcggaaaaagccgcacaacagttgttcggggcattactcgcgaaagcattgcaattccctgatcaaaaccatgtttatctggtttctggaaagccggtcattacgttctggggatttgtcagccaagataaaaaaatgcgtagcgatccactcgattgcttacggcagtccactgacgtcgttgagtcggctatcaaagttgaatctatcgtcaaagctgaatctaccgtcgtaccgccagaaatacgggcaaaaacggttgtcacacccgcagcggttgagttatcaccacaagccgacattatccccaccccgcaattggtggcagagccggagatcacagtagggtctgagctgataaaaacgccagttcgctggttgcgtatcggtggagtgctttctatcgccgccttgattggggcactcgtcgcacagttcagtggcaacctacccggcagtaccgcgcctacggctgaaactcagtcttctacggcagagcacatgacagagcaactcgagccatcggcatcacataagccccaagtgacagcggatgccctcgcgccagtagagccaataaccgcatcggttcccccaccaatcatgcagccactattaccgttggatcacgccccggtcccgcccgacgccaaagtagctgcagagtcgatagttgcagaaccgatggctgtagaaccgatagctgtagaaccgatagctgtagagcctgtgactcccccggtgacacgggctaacaataacgcgctgatattaccggctaatgcggtgaaaattggctccacggcctttctcaacggtaattggcgtgccatccctgagattaaaagctcactcacgggtaaaccaccgagcctgagatatcaaattaaacaaggcaagggcagcgtaaaaatcacccatggggataatgtaacgtgtcgtgccaatgtcaccgccaggctgatgaaatcaggcaacttggtgatcaacagccgctatcgagcacaatgcagtgatggctcaaaatatcaaatacctgaaatcgtctgtaaacaaggcaccacagatattgccgattgcaaaggccgctatgatgccaatacgaccctttcaatgacgatgacgcgtgagagtaaataatattatgttggcgacgatcactgattataaacagaaaattacactcattcaggatagtgggatccagttcctggattttgctttaacgccagaatcagacactgagctacccaataaatttgtccgtaaaagtgccaatggcccgttgttacgcctgaattaccatgaacacaatggtaaatattcactgatgctcccaggggcagcccctgagattgtgaaacctgaatttagtattccactagagcaatcactgaagttattgaaccagatttggctacctttgccgtttttgcgatttaccccaccccacacctttattcgtgggccagataattgggcccgagtacaaatattaacgctggacacgccagatcaagatggcaatacgttacgtgtcacgttggcttttgatactaaagtgtatcctgaaagccacgataacgactatttggcccccactgaaaacgatatcaaaaccggcctgagtttcgcactggcttaccataatgaagatctggccgagtttctggatttgacgtgggtcgatggctggctgcgggacgtgtttacccaacaagctgccgagcaagaagaacgaaccgccagacatattagcgcctcgctcagagagtttgaatatcaagcacattatctgaatgtgctggcgttacttggcagtcagctccgtataccggaaatcaaaatcaccacgaatacgctgcaagaacctgcggttaacgtggatttaatccttgatgtgggtaactcacatacctgcggcattttggttgaagaccatgccgatgaaagttatgggctaaaccagacttatgagctgcaattgcgcgatctgagtgaacctcactacctgtataacgcgttatttgaaagccgagtggagttcgcgcaagcaaaatttggtcagcagagtttttcagttgaaagtggccgtgaagatgcctttatctggccttcgattacccgtgttggccacgaagcctgccgtatggcattacagcgcttgggcaccgaaggttcgaccggtatttccagcccacgacgttatttgtgggatgaagagagttatgctgctggttggcgatttagcggcacaccaaccgccccccatgaagggttggcaaccgcgcttcccttaacccttttactgaatgatgatggcgagccgctgtatcgtttaccggctgaagaacggctaccggttttttccccccactatagccgcagttcattaatgacctttatgttgtctgagctattagcgcaagcactgatgcaaatcaacagtgcggctcagcgcttgaaaatgatccatgtcaccgctccccgtcaattgcgatcgattatcctgacgctgccctccgcgatgcctaaacctgaacgtgaaatttttcggcaaaggatgaatgaggcgattgccctggtttggaaatcgatgggctggcatcccgctgatgacgattttgtgacgccagccgatcacgcaaaaagtaaagtgcccgtaccggacgtccaaatggaatgggatgaagccacctgtgggcagatggtttatctgtataacgaaacacaagttaactttggtggccgtaccgcagccttctttgccagtatggcgcgccctgataaacaactcgacgcgggcgaaacggcaggtaaaaccttacggatcgcctcaattgatattggtggcggcaccactgatttggccatcactcaatacgggctggatgagggtattggcaataatgtcaaaatcagcccacgtttattgttccgtgaagggtttaaagtcgcgggtgacgatatcctactggatatcattcaactctatattttacccgcgttgcaggcgacgctgaaaaagatggcggtggtcaacagcgatggcgtcatggataaattgttcggcaatgatggccgcatggatgggcaatccgtcctacggcaacaagcaaccttacaaattttcatgcccgttggccgcgcgatactcgaagcgtatgaaaacttcgatcccttggatacccgagcagagatcgaagccagttttggggaattactgacgttacagtcatcacagcgacaacgatcaccacaacgacaatcgtcatcacaacgacaaccctcatcacaaccacagcagccgacactgaaagtactggaatatatcaacagtgaaattcaacgcgagctacctcccgatgccggtgtatttgatattttgcaggtaccactggtcttaaaattaagtcaattacacggcgaatttttatctaaccggatgagcatcacacaaaatctgcgagcattatctgaagtggtgtctctctatgcctgtgatgtcttgctactgactggacgcccttcgcgctttcccggtattcaagcgttattccgccatctacaaccgttgccgaataatcgtattttgtctcttgatggataccataccaatgattggtatccttttaacaaactgggtcggattgataaccctaaatcgactgccgcagtcggcgctatgctctgtctgttagcactgaatctgcgactggcgggcttctactttaaagcgggcgatttccagccttactcaacgatctgctatctcggtatgttgagcagtagccacaccttgaccaccgaaaatgtttactaccgcgatatcgatctggacagtgccgactataaactgccctctgatgtccatttccagctccggggttctctctcccttgggttccgtcagttggataatgaccgctggccagcgtcaccgctctacacgttatcgattgtcgaacaagagctggctcgcaaaattgccggtaatagtgtgttgagcgtcaaactgaaattggcaaaaagcgacaaacaaacaggtctggaacgttttgaactcgcagaggcgaagctgcaagacggtagccgtgtgcccttgcatcatctgcgacttaaattgaacacattagccagcaatggctcaggatccccccattattggatcgacagcgggagcgtatttagaaaatgaaatcattaaccccgcagttacttaatggccaacaacttcatgaccagttacagcaggtaacacaaggtatcgaccaagcgattgattgggttaagagtacccgccaacatgctgttcgtttggatagagaagccgaacacttaaccattaagttacgccgtatgcgtaataaagcgcaccctctatctgagaccgcgctaaccgcgatgactattggttttgtggggcactcacaggcggggaaaaaacaccttatctcggcactggcggccaatgaacatggccgattggaaaccacgctcgggggggaaaaactcgacttttggcaacaaattaggccggaatatcaaacaactggcttggttactcgctttagctatcagacagaaggtcatcaaacgcacggtcatgaaagcagagcaacaaatgaagcctatccggttcagctcaccttactcagcgaagtagatatcgccaaaatcatcgcccgtgctttcttgctggattgccctcaggaaaatccagcttattcgttggatgagcaacagattaccgaacatctacggcagttgatgatgcacaggcggccaatcattaacgctggaatcaatagcgatgatgtgattgcactttgggactccctggcccaccacgacacacaacgccagaaagaactggcgactcacttctggcctaccgcgattgaactggcaccgtatctgagtattgatgaccgggccaaattattttcgttattgtggggaaaaaacgatccactcactgacgcttatcgccatttttcctacattttgcagcaccttagcggcgcacagcaattattagcaccgctaagtgttttggttgacgataccctgttacctaccaatggtgtcatgaatattgccacgcttggtgacttgaatacacctgcagataaccctatccaagtgcttcccttgatcagcggtcataccgcgaaatgcgtgacactgtcacaagcggaattgacgctgttagcggtggaactgaagatcccactcgataaacccgcgcgtgaaagtgcatttgaatccgttgaattgcttaattttcctgatgctcgcggttcgcaaactatcccggcattaatggaaaacgccgcttatccgctggcctcgctactgtcacaggctaaaaatgcctatttactcgaacgttataccaaccaacagcaaatcaacctgttattggtgtgtaccgccaccgatcagcgttcagagataaaaagtaccagcaaggcattggattattgggttaaacagactcagggagagagcgttcagatacgctcgcgtcgtaatccgggtttaatctgggccttaacgccccatgatcagcgcattaccgcgaatctacctctctccaccccgacagacgcccaaacgcatgacgcgaatatcaaaaattacgatgaagcggtacaacgctatgttggtaatcccggtgacagttggggaaccctattagcattggatgcacgtggggttgaacggatgatctcgtacctatcgaaagaaatccttcgggatatcaaatcagaacgtctaaccgaacaacttcacgagttacaacgggaactgaccaataatctgttcgcgggttggtatcaaccttcggttacggacgaacgacagcaaaaacaacgtattgtagaaatattacttaaagcgttgcaaacccgtactggggtacatggtgaattgttggagcaattacttccttcccgcgatgaactacgccgcctttatctgcaacagcacctttatctatcaccccgcctttatcaacaagagaaaaaaggggttgcggattttttcacaccactcgccagcactgaacctttcagtatcggtatcgatatcgatctgtttagtgaccttcccactcccactgagccatcgctgacaccacaagccagacatgataacgatgaagcggagtatgccgctcatgtgcattattattggataaatcatctacgccaactgcccgataatactgcgctacttgaattactgggcgtcactaaacccacgatagaactgctggtcgcggaattcatcactgccagtattcggctggatattgctgggaatttacgacaggcactggctgataacgaaccggcggatctgcatcgtgcagccaaagcggaccgtcaggtttctcgtgcgctcactgtactcggtgatttcattgcctggttaggttttttgcaaatcagcgaagataagcgcccggatagccgcatcaaccgagggtataaaatttttgtccagccccctaaatcagtatcaactttaggggtctctcaccggttaacgcaactggcattaaccccaaccaacagtaccgcattttatatctatgattggttagtgggtttgggtgaaatgattattcaaaacgtgggatattcagccagtaatgagataagcccggcacagcggcaacaactggcggcaatattatcggtgataaaacccgcaaatgattaaatagatggctgataacgttaaataaaggggaacgtgccacaaaaatgcgcaactccccgacggagaagcgcattttttaaacagcagaactcaagtgacatcagtaagtaaaattattttttgggctggcgttatactcgtgcgcgttgcatttgccaacggctaacctcatagcgcccgtagaacaataattcccggtgtcttcttcacatactcaatgaaaggtgaatcgacgactttttcattcactttcagcgaagacgcattacgcaataccggcccattttttgtcataataaaaatacccgtatgagtgacatccagccccgcaatatgggtataaatgccgatataatcacctgttctcagtttatcaataacagagtcgttgataaactcagcaggaatatagctaacatcgcgcttgaacacacccagcgttgggataaattccccgccatcacttttctgattgagatattttgtaacagttaacgtatgagcactaatttcagcggtaatatccttggcatttaaaggagggcgagatgaccaatcggtaaagaaatgtttccgatgttggtaactaatatcactatcaatatatctaacccctaccaactgtttgataaagtcatttttatttttagatttacgcaaagattcgacataatccagataggtaaagcagtctaaccctctgaaatctattactagtttttctggttctgttgatgagccaatcaacatattcgctttgtaaggtgtccctaaaaattcggctgaaaccttcgcgatgatttctcccgtattagattgatcggctgtttttacttgcgtttctataatgctattgattcgatttgatgtgtaaatgtcaatatcaacggggttgtgcgtatttttcttagcaccacccccggctaagatagccattaaaattaagggtaaagatttattcataaaatccctctatgccttgttaacctgttatttccatataatattttcatcgttactctactatttaaattttaaactaagcatcaacaataatacattaaatgacttaccactacggacaagtggctgccttttgctactatatccagccccagaaaaaatcataacgtcagactgctgacaaaccccgatgacgcgatcttgaacggtgaggataggcagaagagtaaagcgtccgcgccagggagggcgcggctcgagcccccagggaaggttttacggcgtctttacgatctgcctgttctctccgttgcgggcactttgtcaataacctcaacgtgaggttttgttatcacctatcacctatcacctatcacctatcacctatcacctatcacctatcacctatcacctatcacctatcaccgcagagtgataagtgataaatcagagcgatgccctctcagacaactttgtgaccgatctcgtgtttttgcgctctgttcgtttcagcctcttgtgcctttttaaaaatcgtgtttatctcttaaagcttattacattttgatgagagtacaccgtgaactattccactgccaatttcgccctactaaacaccgcgcatgttgccgcggtcgtcgtcgtgcgcgtggtggtagtcggcagcgcgccgtaacgggtaccgaatccagaaagattcccaaaccccgccggcgccagccgagcggggtttctttttatcgcccctctcagttaccgcaccggccctgatgaaggatataactatgcgttatacaggcgcccaattgatagttcggttactggaacaacaaggcattactcttgtaagcggtattcccggcggtgcagccttaccgctgtatgatgccctagggcaaagccgtattattcgtcatgtattggcacgacatgagcaaggtgcgggttttatggctcagggaatggcccgagcaaccggtgaaacggcagtttgtttagcctccagtgggccaggtgcaaccaatttagtgaccgcgattgccgatgccaaacttgattcaatcccattagtttgtatcactggccaagtcccatcttctatgatcggtaccgatgcgtttcaagaagttgatacttacggcatctcaatacccatcactaaacacaactacctcgtccgcgatatcagcgagttggcgcaggttattccacaagcgttccggattgctcaatcagggcggcccggcccggtatggatcgatattcccaaggatgtacaaacggcggaaattgacttagctaccctgccaccaccgggaattgccgatactcctggcccagtagacctctctgctatcgcgcaagtcgccaagatgattaaccaatctgtacggccagtgctctatttaggtgggggaattgtcagttcaggggcgcatcagcaagcaatacaattggcagagctggcgggtctgccgacgacaatgacgttaatggcattaggcacaatgcccgttgaccacccattatcactgggcatgttgggtatgcatgcggctcgctcgaccaacctgattatgcaacaagcggatttattgattgttctcggcgcacggtttgatgatcgggccatcggaaaggcagaacaattctgccctcatgccaatattattcatattgatattgacccggcagagttggggaaaatccgttgcccacatttggcaatgaatgccgatattgcgcaggtattgacacatttattgccaatgatcgacgctcagctacgcagcgattggcgttcaactgttgccgatatgcagcgtgaatttccattcaaccaacccaatagcgaaaatccactgtgccattatgggttgattcgtgctgctgccgaagcactggatgacgagaccattattaccaccgatgtcgggcagcatcagatgtgggtggcacaggcttatccactgcatcgcccacgccaatggttaacctccggcgggctaggaaccatgggctttggcttacccgccgcgattggtgccgctctggcaaaaccagaaagtaaagtggtctgcttctctggtgacggaagcctaatgatgaatattcaggagatggcgaccgcggctgaagagcaactgaatataaaaattattttgatgaataaccaatcgctgggattagtccatcaacaacaggaccttttcttcggcaaacgtatttttgctgctgattacgcttatcgcactaacttcattcatatcgccgagggattcggtttctctacctgcgaccttaatactgccagcgatccttatactgcactgcatgaagccttaaatcgccccggtccggtgcttatccacgcactgatcaatgtggatgagaaagtttacccaatggtgccacccggcgcggcaaatatcgatatgattggaggggaatagtatgataaatcaacaaaaacccactcagcaagcatctgctcaacatgaatcagctcaaccaatacccactcgggtcactctgctcctgacggtgcgtaaccatccaggtgtgatgtcacatatctgtggcttatttgcccgccgcgcttttaacgttgaaggtattctgtgtatgccgctgccaagtggtgaagagagccgtatttggctgcaggttttggatgatcaacgcctgctacagatgataagccagctagagaaactggtggatgtgcttcaagtgcgccgtttcgggccagaaatgccgatttttgatcaagtagaagacttggttgccaatcaaaggtgacgttgtcacacgttaaaccctgtcgttactgccgacagggtttaacgggcttattcgagtagggatttatgcaaataataacgcctgcaattcggctaatgagctcacttgatagcgtggcgcaatattatcatccccggcaacaccctgtgtatttaaccaacacgtatcgatgcccgcattaattccgccctgaatatcggagtgtaaattatcgcctaccatcaaaatatgttctttaggtgggttatccattacgttaaacgcatactcaaaaatggcaacatcaggcttagcgacacccacttgttcagagataatcagaggtgaaaaaatatctttaaaccccgtgcgctctaaacgaatggtctgcaactcagtgaaaccattggtaataatgcccatgtttactttaccgcttaaggcatcaaccagttcgcgtgcgcccggtaataatgaacaaatatctgccatcgccagtaaaaactcactgttcagacgtgttgcggtgacgcccaatttttcggcccacatttcaaaccgtgtattttgcaactgggtagcggatattttaccgtcttgataatcgacccacagtggcttgttaactaattggtaatggtcaaaatcttgcgcagaaaattcaacattaaagcgtgagaacatcagctttaacccttgataagcgtcaaagtgaaatagtgtttcatccgcatcgaacaatatccattggtatttcattactattgtttctctgacgttattaggcgcgttatggtagcgattattgcgtttgagctcaagttacgctgccgatgtttattaagactatgtttattgagcctatatttattaatcaactgtctgcttatcaggccaataatgcagccgagacatcacgattaattgaaataaccgcatcgccagtaatcagcggtacgtcaaaaacagccaatatcttgcgattaatctcaatcagtatatcgtccagtctgatttccatgtccagcgcgatatcggttaatttatcacgctcccatgcattgcgtgaaatcagtaatcgtaggagcgtcacggttccttcctgcatatcagccattattgccgccattgattgtggatcaatctcttctttatcctctgtcgccaccactttggttagaaataaattctccaacagcgccaccaattcctgactttcatttttcagtagcgtaatgcgatcaacactatttagtgctaccgaacctggtggcggcaaacttaatgtcatcggggtcgcacggctatcaagatcggtataaaccagtttgctgtctagggcaaaacgcttatatacccgctcaagaaatttcacatcttgtggggtaatggtcccttcgacctgaatcaggtgtgccaggaaacgggcaatagcacggcgatgttcaagcgatagcggctcaaggttatttttcaaggccaacaacgtattattcttcctgacccccggttgaagataggctttcagacgcatacgttgaccagggctaaggtagctccaggcatcaatatgccgcgtcaaaatcatcgattcgggttccccaactcggccatcaaccatcactgcggcacaagccaactcgacggctaacatcgtgatacggtagacagcaaaggttgccgactccgccgtcgcggactcaataggaaacagagcaactgtatcttgcaaggttggtgtacgattatctgcccgaacatcaggctctataccaacctgcaaggatgccaacgcctgagtcagcgcaatgaccacattgcgggataaacgttctagtgggtttgatgcgcaggcatggctgagttgggcaaaaagttcatccaatgttatcaacagtaagccatagcccactcggcttttaatactttccagctcagcgtttaatgcctctggccacaacggcatcgggagaagtaacagcccttctaatgctgcttttttcttaggattcaaactcacaaagcggttataagcctcgagatcgttctgacatgcttcaattaatggccgcagcttatctctattggctttacatactgccacgttgggtaactcacccatctgctggatgaactcttgccccattaaccctgcggaagcaggacggtagaaaatatgtagtttggttttattgacgggcaagataaagccatcgccgtatttatcccgatagcgctgttggaaaagttgggagaaggcatcaggacaatgcatcaaggatctgttttggttaatggctggatccgcaaccccccacgcacaggcccactctgcaggtaatggccgttggtccacagccaattgccctaagccaaccaacaaagcaagtggcagttcggttgaggcatttcggcttaatggcggtggcaataaatagagcgtctcctctatatcgactctggcgatataaattaataaattctgagcataatgattaaaagtgttattttttccataaatattcagcaatcggttaatttccgcctcaataatgggcagctctcgttttgcgattggatcaatactcgcatcaatcagtacgcggtgctctaatccataaaaaaataagaaaacataactaatatgagcaattggagatttacgaccttccgataaccattgtaaatacgcttttctcgcctccggggaacatgtcgagtaatcgggggcgttatcgatcagcgccaatgaaatgtctacctcttcttcggcgacctgcattgatggattgataaaggccggctctgctccggtgcgattgctcttatgtttattaccaatgtagatcatgccatcggctaaggttatcccggcaaccacggctaattcgccggggcgaagccaggacgcacgggccagagagcctcttgaaatttctgactgtttagtactcgcagagggtttatcaccagaagagggtttagcactagcagattgatcaaggtgatcggtaagctcatcatcaatgacgagttcaggatgaagggccagagagtctagctgataaccgcccagatcgggtatcgctgaggctttcggtacgtctgaattgatggacggtccagaaccaatcttagcccaacggatatttttccaaacaaaaaacaggcataaaatagcaaaactcagtgcaacccatgcttctcttgggatatctgtcatcagccctaaagcgactatcagtaggataacccagccggtaccggtagattttctcttcgccacgatggtttatctgcccctatcttaaaatagtaatttttattctgcctttactggcaatttttaataaatacttcttttaaacaaaacttttttaaaacagactgccgtaacacagcagaaaaacccattaatttcacttaagtgcagttaatgggttaaataataagtcagttttacttattcaatgtgaaaaataatccaatgtaaaaagtggatatatttctttcgcacaacgccacgccagtagctgcgctcaatacatcgattatgccagttgattatacattcagctagcaaagactctgtattcagttagctgaaatgatgcagtctgcaggatgcatttttctatacccaaattcattggaacccaaagtcattggagtacgggacgcaggtaaagacaaaatggatagcattggcttagggaaattcgccaaatagaaacagaattttccagatataagcaggattaccgtgacgggacataagcaaaaatcccggccattactgcgccgggacgttccagtgagataacaggcgacttatttaagtgccatcgcatcccgcatggtgaagaacaaatcagtttggtcagttaaacctacgacgttagccgcgtgaggaccataagccgctatccgcaattgtgacccagtatggccttgagaatcgtcttcagagttaccgtagctgatcgccatgaccgcgccatctttggtcgttaatgcctgagtcaggcccggagccttcgcttcaggctcgataatttggctggagtgagcatggtcagccgtcacaatcaccaaagtgttgccatcagcacgggcgaattccagcgctttttgtaccgcttcatccagatcaaccgtttcaccaaactgaccacatgggttagcggagtgatcctgtttatcaatcgacgccccttcaacttgcaagaagaagccattctcattggttttcagcaggtcaatggctttttctgtcatgacagccaacgttggaatgtcgctggtccgctcagcattgttttcacacaccactggcggtttatccagattgccatgataagaggctttcggcccctgccaacgcactggcatattacctggcgagaataagcccaatagaggtttctgttgattagcgtgttttattgcattcaggtcatcaaggttctcaacaatgacgtagccgcgggccaacgcctgatcacgcaacgactggtctttccactcaccggctttagcgacctggctgaatgatgctgcaccaccgccaagcgtgacatcagcgcgcccttcaatcatctgctcagtaatagagccacggccccctttttccaatgcattggtactgcatttctcactggtttcttccgggccatagcacttacgcccggtcacgtgggcaaactgcgcagcaggagtggcatcttgtagttcagcggtagagacattacccgtcgctttgcctgcttttttggccagttccagcaacgtaacatggtctttaccaaaaacatcaacccccaacgcaccattatacgtttttacgccagatgaccaggccgtcgctgatgcagcagaatcagtcacataatttggtttttgtgtttttttatcgagtgcatagtgcgtgtattgcccggtcagcggcagcgcatcaatgcctttaaagaaaccaccggcccccatcgcatagttacgggcagacgtgatttcagaatcgcccatcccatctccaatcaacaaaatgacattttttactgttttattggataacgagtcacgcagagcctgggtttggtcttcagtcaaacgacgtgcgccgccaaattgagtcacatcaccatgcgcagcacgatcatataagcccgtagcagccgcaatcgcattaggcgttaatagcgcactggacagtaacagagtcgataatgctatgccggatgataatgctatgccggataaagtaggtacacggttcatcgatataattccttgttgtaaaacagtcatacaatttgtattgattggttacaacggatactagaacagccgggtgacgcttttatgacagataccactaattatcattcaaacgtttgccctctcattttcataccccatatcatacgaacgccccattaagtgacctaatgactcgatgttttatgcaataataattatggaaaaaatttaaccagtgaaaaaatttaatccgtgaatagcaactatggagagttatgaaaacgttctttattgatcggatggcgaccccacagggcgaactattgcttattgcagacgaagaaaaccagttgcgtgccattgattggactgatcatcacgaccgcctgatgaaattactacgtaaccattacggtgcggatacgttcactttggttgaaaaacgcaaccccggtggattgagcgagagtatgcagcgctattttgcgggtgaattaagcattattgatacccttcccgtcaaaacagcgggtaccgactttcagcgccaagtctggcaagaactacgcaaaataccttgtggggaaactatttcctatggggaactggcaaaacgcattaatcgccccacggcttctcgggcagtcggtatggccaatgggctgaatcctatttctattgttgttccttgccatcgggtgattggctcacaaggggcattgactggttatgcgggcggagtggaccgaaaacgttggttattagtacatgagggttatcttttaggttgctaatcattgttgctcttatcagaagcactaaaagatgttaaaattgacgcatatcaatattaatgggaataccctatgatccctgaaaaacgcgttatccgacgaattcagtctggtgggtgtgcaattcactgtcaggattgcagcatcagtcagctctgtattccgtttaccttaaatgagcatgagcttgatcagctcgacaatatcattgaaaggaaaaaacctattcaaaaaggacaggcgctgtttaaagcaggtgatgaacttaaatcactgtatgctatccgttctgggaccattaaaagctacaccattaccgaagaaggcgatgaacaaattaccggtttccatctggcgggtgatttagtcggtttcgatgcgatcagtaatctgcaacacccaagttttgcccaagcgttagaaacatcaatggtgtgtgaaatcccatttgataccttggatgatctttccggtaaaatgcccaatctgcgccaacagataatgcgtttgatgagcggtgaaatcaaaggcgatcaagacatgatcttgctgctctctaaaaagaatgcggaagagcgcctggccgcctttatctacaatctatcccatcgttttgctcagcgcggtttctcaccacgtgaatttcgcttgaccatgacccgtggtgatattggtaactatttaggcctgacagtggaaacgattagccgcttactggggcgtttccagaaaagcaatattctcagcgtgaaaggaaaatacatcacgattgagaataacgaagcactggctcagttggcaggtaacccaaaacctcggctatagttagattgttagaaaccagatcaataaaatgcctacttattggtctggttatccctctctcacctatcctgtttctctatcatggtttactctttaactaacagactgttaattcacggttgtaaggagacgctatgggaaagtatcagaatattctggttgctatcgaccccaatcaggatgatcaacctgcattaagacgcgcggtttatcttgtgcaacgcaatggtggcacaatcaaagcatttttagctatctatgacctgtcatatgatatgaccaccttgctatcaccggatgaacgcacagcgatgcgtaaaggggttatcagccagcgttcagcttggatcagtgaacagtgccgtttttatatcgactcgggtatccccattgatataaaagtggtatggcataatcggccatacgaagccattattcaggaagttctgaaggcgaagcacgatttattgctaaaaatggcacatcaacacgatcgcctagaatcaattatctttacgccaactgattggcatttattacgtaaatgtccatgcccggtgtggatggtaaaagatcagccatggccagaagaaggtaccgcgctggtggcggtgaatctctcaagtgaagatccactacatgacccgcttaatttacgcttagtcaaagaaacccttgagctggcagaacatgtcaaccaaacgcccgttcatctgattagcgcctacccagtgaccccaataaatatcgccattgaattacctgattttgacccgagtgtctataacgatgctattcgcggtcagcatttggtggcgatgaaagcattgcgccaacagtttggtattgatgaaaaattcactcatgtggagaaaggcttacctgaagaggtgatccctgacttggctgaacacctgaatgctggggtggtggttttggggacattgggccgtaccggtttatctgcggcctttatcggtaatacaactgagcatgtgatcgataatttgaaatgtgatttgctggcgattaagccagaaggatttacctgcccgatagaaggcaatgaagatcaggaggatgctgagtaactcccttccaaaggccgccctacgtaaaatcctaaaataagggccaccgaagtggccctcagactgctgacaaaccccgatgacgcgatcttgaacggtgaggataggcagaggagtaaagcgtccgcgccaaggatggcgcggctcgagcctacatggatgtatttacggcgtctttacgatctgcctgttctctccgtcgcgggcactttgtcaataacctcagggccaccgaagtggccctgagcaatacaatggatgttaatcaacacattttaattattcagtgcacgtaaaatagcttctacgctgtctttggcatcaccaaacaacatttgagtattttctttaaagaacaatgggttctggacacccgcataaccggtattcattgaacgtttaaaggcgatgacactgtgtgctttccacacctcgagtacaggcatacccgcaatcgggctacgtggatcttcgagagcggcggggttaacggtatcgttggcgccaatcaccaggacaacatccgtacttgagaaatcatcgttgatctcatccatttccagtacgacgtcataaggtactttagcttcagccaataatacgttcatgtggccaggtaaacgcccggcaaccggatggataccaaaacgcactttgatcccacgagcttgcagttttgcggtaatttcagcaaccggatactgtgcctgcgctaccgccatcccatatcctggtgtgataataactgaactggcatttctcagttgttctgccacgtcttccgctgtggcttcacgatattcgcccatttcttcagcattgccggtagaagaaccatcagtaccgaaaccaccggcaatgacactgataaatgaacggttcatcgctttacacatgatgtaagacaggatcgcaccagaagaaccgaccaatgcacccgtcacaatcaacaggtcattactcagcataaagcctgctgctgctgctgcccaaccagaataagagttcagcattgaaacaacaacgggcatgtctgcaccgccaattgaagccaccagatgccaaccaaagcccagcgcaattagggtcatcaatagcagcgcaaccacttgcagggtaatactctccgttctaacgaacgtaaccatcaagaggaaggaaacaaccaacgccaccagattcagcttatggcgttgcggtaacatcaatggcttggatgagataaccccacgtaacttaccgaaggcgacaatagaaccggtaaatgtcaccgcaccgataaagataccgaggaagacttcggtcagatggatgttctccatcaccgcatccatcatcgaaccatgatccagatagctgttaaaaccaaccagaaccgcggccagaccaacgaagctatgcagaatcgctaccagttctggcatttcagtcatttcgactttcttcgccagatagataccgatcgcaccaccgatgaccatcgcaatgattatccaagcgacattacttgaatctggccccagaatagtcgcaattaacgcgatggccataccggccacaccgaaagaattgccttgtctggatgtttcatggcgcgacagcccagccaaactgaagataaataagatcgcagcaactatgtacgcagctgtaacgagaccactagacatcagttacccctttgtttttatatgacatttttataccagctaatttctatgtagcttggtttttacggaacattagtttttacggaacattttcagcatgcgctgggtgacagtgaagccaccaaaaatgttgatgctagcaatcagtacggcaataaaggagaagaaacttacccagccaccatgaccaatctgcaacaacgcgccaaccacaataatgcccgaaatcgcgttagtgactgacatcagcggtgtatgcagcgcatgactgacattccacaccacgtagtaaccgactacacacgccagtgcaaagaccgtaaagtgagacaagaattctggtggtgccacattcgccaaccaaccaaacaacaccatagcaactgccataatgatgtatttggtccacggtgatgagggcttcgtttcttccttcgctattggggccgctttggcagcctgcggctgagctgaaacctgaataggtggtgcaggccaagtcacttcgccagttttaaccacagtaacaccgcgaatcacggtatcgtcgaaatcaatatcgatctcgccgtttttctctttgcaaagtaacttcaataagttaacgaggttagtaccatagagctgtgaagactgcgtcggtaagcggcttggcagatctgtatagccaatgatttttacgccattttccgtgatggtgacttcatcagctaccgtcaactcacagttaccgcctgtctgagccgccagatcgacaatcacgctgcccgacttcatcgacgccaccatctctttggtgatcaggcgcggtgctggtctaccagggatcagcgcggtagtgacgataatgtccacttctgcggcttgcgcggcaaacagttccatctcagctttgataaaagcctcggacatcactttggcgtaaccatcgccactgcccgcctcctcttcaaaatccaattcaaggaattcagcgcccatactctggacttgttcttttacttcaggacgggtgtcaaaagcacgcacgatagccccgaggctccccgccgcaccgatagccgccaaaccagcgactccggcaccaataaccatcaccttcgcaggtggaactttacccgccgcggtgatctgcccggtgaagaaacggccaaattcatgagccgcttcaacaatggcacggtaaccggcaatatttgccatggagctgagggcatccatggattgcgcacgggagatacgcggcactgaatccatcgctaatgcagtaacttgacgctctgccagtttttgcagcaactcagggttctgagcgggccaaataaaactgaccaacgtgctcccctcacgcatcagcgcaatttcatcctcaaagggagcattcaccttcaggataagatcggattgccacacatcagtggtatccgtaatgatggcacccgcttcttggtacgccgcatcgtcaaagctggctaaatgccccgctccactttcaattgccacggtgaagcctaatttcagcaattgttccaccgttttcggcgttgctgcaaccctggcttcattggccaaccgctctcttggtacaccaatacgcataatgtcccctttttacctgtttttgatgatgagtattgtcatcctgcttatcgttcggttctgtttgttcaccgacaaaacctgctgagttacgctccctataacctactgaaaatgtgactaatgatccatatctgtgtgagcttctggtgcagattttgcagtaaaactggcaggcggaaagaactctgtataattaactataaaaataatatttactagcggcttgtcctgtaactttgcacccaaataacccgcgcagtgaaaataagacaacccagtgatggcgcggtgcgacgttgcaaaaatgtaaataaacagcacttgtgtggttaaagcgacggcttgtaaagtttctccgtattcttaagataaagaacaatccgcctaaaccccacgattgatataccaagccgtataaattgctgagacacttgccattattacatgcaataatcatctgctattctgttacacatcaattgttccgcacgtatcaacgttaatgcgcaaggcgaaaggattttttatgaagctgaaatacacgatcatcgcatcggcattgctatcactcactgcgttctctgctgcacatgcagcaaaagaactcgcaccagagcaagcagcagccattaagccgtttgatcgcattactattacaggcagatttaatgcaatcaatgaagcagctgatgcggtatcccgccgtgctgataaattgggcgccaattccttctacatccaggatattaacagtagcaataatggtggtaactggcgtgtaacggccgatctttaccataatgatgccgaggaagtgagcaaagaaactcagtatcgcgtctttaatggtgtgagagaattaccaaaaacagaagcgtatacccttcagccttatgataccgtttctgtgagtggtttcttccgtagccaacctgacattaacgatgcgatctctaaagcggcaaaagaaaaaggggcatattccttctttattgtgcgccaggttgatgctaatcagggtggaaaccagtttatcactgcttatgtctataaagccgatgcagcaaaacgtctcgtacaaagcccggatgttatccctgcggattccgatgctggccgtgcagcgctggctgcgggtggtgctgcagccgcaaatgttgaaattccaggtgttgcctcatccggtacaccaagcagtgatgtaggccgtttctttgagactcagtcatcaacaggaaaacgttacactgtcaccctgcctgatggtacccaaattcaagagttgaacaacacaaccgcagctcagatggtgccgtttgattctgtcagctttactggtcacttcaacagtatgacggatgtctcgcatgaagtggctaaacgtgccgcagcaaaaggcgctaagtactaccatgtgactcgccaatggcagaacaaaagtggtggtaatctgagcgtcagtgccgatttattcaaataattatcttaagggcggccaagtgctgcccttcttttatccgtgttgcgttcattttttatcccccaactcatactgaataattttttgttaaaatcgcatatccaatcattgcatcatcaccaatcactccgtaaaatccctcaaaatttctgggctattatctgttagatattgataaatttgcctcatataatgctatttacaagccagtaatcattcattaatactttaaaatcaagtcattaatattttaaaatcaggatccataattggaaaagaaactcggtctgactgcgctaacggcgctggttcttagctcaatgctgggagcgggtgtctttagcctgccgcaaaacatggctgaagtcgccagccctgctgctctgctcattggctggagtattactggcatcgggatcattttcctggccttcgccatgttgctactgactcgcctacgccctgatctcgatggcgggatatttacctatgctaaagaaggttttggcgacctcatcggttttttctctgcgtggggttattggctatgtgcggtgatcgctaacgtatcttacttggtgattgtttttgcagcactgagcttttttaccgataaatccggcagcatcatttttggtgaaggtaacacctggcaggcattgttgggggcatcattcctgttatggctggttcacgctttggtactacgaggggtacagactgcggccagtatcaacttggcggcaacactggcaaaactgttacctattggcggctttattattctggccggcatcgcatttagcctcgatacttttagtatcgatttcactggcttagcgctacacacgccggtttggcagcaagtaaaagataccatgctgattaccttatgggtctttatcggtgtcgaaggtgcagtggttgtctctgcccgtgcacgcaacaagaaagatgtgggccgtgccacgatgctagccgtaatttcagcccttagcgtctacctgttgattaccttattgtcactcggcgtggtgcctcgggcggaattagcgggtatgcgtaatccgtcaatggcaggcattatggtcgaaatgattggcccatggggagaaatcattatcgccaccgggctgattatttctgtctgtggtgcttatcttagctggacaattatggccgctgaagtaccgatggtggcagctaaacatggcgctttccctaaaatattccgtcaccaaaataaaaacaacgcgccagctcaatccttatggttaaccaacagcgcggtacaagttgcgctggttttgatttggctgacaggcagcaattacaataccttactgacaattgcctcggaaatgattctggtgccctattttctcgtcggcgcattcttatttaaagtggcattaaagcggcaagattggcgtttgattgttgctgccagcggggcttgtttgtacggtttatggctgatttatgctgctggtttagtgtatttactgttgtctgtacttttgtatgccccaggattattggtgtttatttatgctcgtaaggggcatgaagggctgagattgctgaatacggttgagcgggcggcgattttcctcgtgttactcgccactatcccagcgacatggttgatgatgcactaggttagtgaccggttcttcaaaaactaatcatttggcatttgggataaattcacagatagacattcatctttctgactcaatgccatttcagcggggaatttctgcttgattgttctaagttgagccgcttccaatgggtaaggcaattggatgtccaatacggtgatgccacgctgttttgctaatttaatcaatcgaataatattggtctcatcattgagttgtgttgataatacttgcagcgccaatgccgtaagctgagcttgcggcgttctctctaattcagtttgtgacttcaccaccataccaaaaataggcatcacgccataaatagcgtcaacaaagctccaatgcttcttgcaagaagcagcgagaaattccgtgtaatcaaagcagacttttccactgcactgtggtgcactgacgcgttcgccactcatcccttcatcctcagttgatcaatacagctattcagtcattaaggggcttggtatataaacgatagacgaaaccaaataaagatgacgatataataaccattgataatataatgaaatgatttgctggttgtctagtcgtcaatcgacgacattaataaactgtttaataagtaatggtattatcgagtgtctgcccttgttacggcctgtcttgttactgctagttttgctattaactagtcttgtcattaactgcacgctattctgagcccagctatttttataagcaggaagacatgagcaaaattgtttttgtggaagacgacccagaggtcggaaagctgatagcggcttaccttggcaagcatgacattgatgtatttgttgagccacgtggtgataccgcacaagccgttattgaacagcaacagcccgatctggtgttgctcgatatcatgttacctgggaaagatggcatgaccctgtgccgtgacctacggccccactatgatggtccgatagttttgctgacatcgctagacagcgatatgaaccatattctctccctagagatgggggcgaatgactatattctaaaaacgacaccgccagccgtgctgctcgcccgcttacggctacatttgcgccaacataatcaacggttacgccaacagactcccttgcaagccaaagagacaataagctccccacccacgggttacaatgcgattcattttgggctgctatgtattgacccagttaaccggcaagtcaatttggatgatgaagaaatttccttatcaacttctgactttgatcttttatgggaattggcgacacatgctggaatcattatggctcgcgaggcgttattgaaaaatttacgcgggatcagctatgacggtatggaccgaagtatagatgtcgctatctctcgcttacgccgcaaactctatgacaatgcactggacccattccggatcaaaacggtgcgtaacaaaggttatttgtttgcgcccaatgcctgggagtccaagcagtaatgagaaagctatttattcagttttttttgttgttattcgtttgcttcatggtgatggcgatgctggttggcctggtttataaggtcaccgctgagcgcgcgggtcgtcagtctttagatgacctgatgaaaagttcactatcactgatgcgcagcgaattgcgggagatcccgctaaaagactggaataaaaccatcgcaacattagatttaaatctttcttttcaacttcatatcgaaccattaaataaacgtgatcttggcgcacaattgaacaaacggctacgtgcgggtgaaattattgcattggatgatgaatataccttcctgcaacgtatccctcgtagccactatgttctggcggttggcccggtcccttatctattttatttacaccagatgaggctgctcgatttagcattattaatcttgattggcctgtcgttagctcttccggtatttctctggatgagaccgcactggaaagatcttctcaaattagaaaatgccgctcagagactgggctcaggccaccttgacgagcggactcatttcgaccccacttccagtctaagccgtttaggcgtggcttttaaccaaatggctgacaacatcaacaccctgattgttagcaaaaaattactgattgatggtatagcacacgaactacggacaccattggtacgcttacgttatcgattagcgatgagtgataacctgaccgaaagcgaacagcaggcgttacatcatgatatcggtcaattggaagcacttattgatgaactactgacctatgcacgtttggatcgcccacaagtttccctcaatctggaacttatcgacctaccggcctggctaacaaccaaaatcatggatatccgctcgattcatcaagagcgtgagatcgaacttgatattccccaccgtggtgattttggtgccgttgacctgcgtctgatggagcgagtgctggataacctggtcaataatgccctacgctattcacatcaacggctgcgcatagggttatggttcgatggcgataacgcctgcctacaggttgaagatgacggccccggtatcccgccagaagaacggacacgaatttttgaaccctttgttcgtttagaccccagccgtgatcgtgccactggtggctgtggattggggctggccattgtccattcgattgcactggcctatcaaggcagtatctctgtcaataccagtccattaggtggggccagtttccgctttagttggccgataaaaacacatttgcctctatccgctgatcagaattaatgcgcgaacagaactaattcttcgcgaacttactatttcgtgcacttgctatttcgcgaaccactatggagtgatttatgacaaccgcttataaccatctgtgtactgcctttacacgcctttcccgctttgaacatttgtccgctattgcgggttgggatatgcagacaatgatgcccgcgaaaggaaatcttgctcgctcagaagccatggccgagcttaatgtattgcagcatcagattctgaccgccccacagataggtgaatggttgaaacaagcggaacaagaattgcttgatgaacaatcgattgatgaactaaaactggctaatttgcgtgaaatgcatcggcactaccacaatgcggttttattaccggaaagtttagtagaggccaaatcattggcgggtgcccgctgtgaacatgcctggcgccaacaacgcattgcgaacgattgggctggttttgcagaaaatctacgtgaagttgtcaaactaagccgcgaagaagccaaaatacgcgctgaggcggcaggtacatcaggctacgatgcattattgaatttatacgaacccggtactaacagcgctgatattgatcgtatttttggtgatcttaagcaatggctccccgcattattacagaaggtgacaactaaacaacaaagcagtgaaccatgcctgatcccacaggggccgttcgatttagaaaaacagcggcagttggggctaaatgtgatgaaggtccttggttttgacttcaatggcggacgagtagatgtcagtgtgcacccattctgcggtggcgttcctcaagatgtccgtatcacgactcgctataatgatcaggaatttctcagtgctttaatgggcatcgtgcatgaaactggccacgcccgttatgaacagaatttaccgcgtgaatggttggggcaacccatcgcacatgcccgttctacagcaatccatgaatctcaaagtctgctgtttgaaatgcaattagcccgcagtaatgagttcctgcaagtgatccacccactggtcatacaacaatttggtgagcaaccagcttttgcagaacataacttcatcgcacttaatcaacgggttaaaacaggccttattcgcgttgatgcagatgaagtcagctaccctgctcatgtcattttgcgctacgaaatagagaaagcactcattggcggtgagattgaagtagaggatatcccggcactctggaatgaaaaaatgcaacagtatttggggatcaatacagagggagattatcgtaacggttgtatgcaagatattcattggacggatggggcttttggttatttcccaacatatacattgggtgctatgtatgcggctcagttattccatgctgcgcgaagcgcaattccggcgttagattctcacattgctaacggtaacctcgcccccctactcaactggttacaacagaatatatggcagcacggtagccgttacccgacagctgaactgatcacaaaagcgacgggtgagccccttaacccccgatatttccgccagcatttagaacgccgttatctctgatttttaattcggaataagcctgacgcaatcaagcttgtcaggcttatttatacctgtcgtcgtgctatccatcgaacctcacgcttcatgtattagctgtctcaactcctcctagttattgtcttgtgaactattgtcttgtgtaacatctttgggagcagatcagggatttgatcccctcttcttgctgaaaatccaatttgttaatatttacaatagaatacgggcatcaagatagttaaagcggcgacatattgcacggtgtcttatcttaaacacttactgtatgttgtaactaaaatgaccagctaattatcgctacctcacatcctgaaaataagaaccccctaagtaattaacggtaaatatcccattaagcactttgccttggagttaacaccagggtttatgatgttttcgtgtcgccatgataggagaacataagataagcatggtagaagaccgcttctgttttccctgtgaacaacccatcaaaatggagtaaaccatgacgaaaaatagttaggccattatcattttgttggtgattatggtgttgtgaacactgcttgcatggggagtattcagtttacttaattggtggcctgcattagctgtaacggctcgcaatcgaaaatcacccgactcgcatcgcaatcagcgcagatttcggctcacattaactgcaaatcaaaaacgccattggctcgcatttatcctgcccagttcgcaatccattcatctcgccctgaaagggccaatgcacgtacagctccaaattgctatattattttctgtgtagccagactggctgcataacctattacaggagaataccatgagaacatcattgttcagtaaaaccccttcggtcacggttcttgataaccgcggcctgaccgtgcgcgacatcgcgtaccaccgccatcccgactcgccggatgttaccagtgagcgtatcacccaccatcagtacgacgcccgcggctttctgacacagagcgccgacccgcgcctgcatggtgccgggctgatgaacttcagctacctgactgacctgaccggccgcatcctgcgcacgcagggggcggataacggtaccaccgtcagcctgaatgatgctaccggacgaccatttatctcggccagtaatatcagcaccagcgacgacggtactgaagacagaggccaggcgatgacccgcacctggcagtatgaggaggcttcactgccgggacgtctggtgagcgtaaccgaacaggtgaccggcaaagccacccgcatcacggagcgcttcgtgtacgctgccaatactgacgcggaaaaaagcctgaacctggccggcgcgtgcgtcagccattacgacactgcgggactggtgcagccggacagcattgccctgaccggtgtaccgctctctgtcacccgccgcctgatgaaaagtgcggataacccggacgccgtggccgactggcagggggcggacgcctccgcctggaacgaccaactggacggcgaaacgcataccaccttgaccaccgcggacgccaccggggcggtgctgaccaccaccgatgcgaaaggtaacctgcagcgcatggcgtacgacgtggcgggcctgctgtcgggcagttggctgaccctgaaggatggcacagagcaggtcatcgtgaagtccctgacatactcagccgccgggcagaagctgcgcgaggagcacggcaacggcgtggtgaccacgtacgaatacgagccggaaacgcagcgcctggtcgggattaaaacggaacgtcccgccgggcacgcctccggggcgaaggtgctgcaggacctgcgttacgagtacgacccggtgggcaacgtgctgaaggtcactaacgatgcggaagagacgcgcttctggcgcaatcagaaagtggtgcctgagaacacgtacacctacgacagcctgtaccagttggtcagcgccaccgggcgcgagatggcaaacgccggccagcagagctgcagcttaccgtccaccaccgtcccccttcctgccgacagctccgcgtatacccgctactcccgaacctatacctacgacgaagccggcaacctgacgcaaattaggcacaatgccccggccaccaacaacagctacaccacaaaaatcaccgtcagcgaccgcagcaaccggggtgtactaagcacactgaccgaaaatgccgcagacgtggacgcgctgttcacggcaggcgggcagcagactcagttacagccgggacagcatcttatctggacggcacgtaatgagctgctgaaggtgacgccagtggtccgcgacggcagcacggacgacagcgaaagctaccgctatgatgcagccagccagcgaatcctgaaggtcagcaggcagaaaacgaacaccagcatgcagacacagcgggtactgtacctgccagggctggagctgaggagtaaaaaatccggcgatacggaaacggaaggcctgcaagttatcacagtgggtgaggcgggccgtgcgcaggtgcgggtgctgcactgggagagcggcaggccggatgaaatcactgacgaccagatacgttacagttacgacaatctggccggtagctgcagcctggaactgggcggtgacggcaatatcatcagcgcggaggagtattatccgtacggcggcacggcggtctgggcggtgcggcgcgcggtggaagcggattacaaaaccgtccgctactctggtaaggaacgggatgcgacggggttgtactactacgggtaccggtactatcagccgtgggcgggcagatggctctccgcagacccggctggcatggtggacgggctgaatctgttcaggatggcgcgcaataatcctgttgcgtttattgatcgtaatggtcttaattcagaattgttatattctcaggcattcaagcggacggcaaataaatataacgtaattattggtgtaagggcacctaatccattaggtgaaactttattaaaagaaggctttccatcaaaaaatttccatatgaaggcaaaatccagtccaacaggaccaaccgcaggttttattgcagaagacccgatttactctaaggtgtcaccttctgcatataaaaaacagagagcatcaattgataaggcaaaagctttgggctcggaatctatagatttattcattagcaaatcacgaattaatgagttaatagatactgggaatttaaattctctaggcgaaaatcgttactcagcgaagtatccgtatggtactcaagagtttgagattggaaataatggaagagttttaaattcagagggaaaacctgttaaagtaatgactaatccaccggagattggagagagaaaaagcaatagttcccccataacagccgattacgatttgtttgcaattataccaagtgttaatcagtcagttaatgaaagacccctgacagtgccccataagttgttacgtggtgatttttctctccccttcaccagtccaaaagggaaaaatggcatgagtgaagatgtaaatatgggaaatcttcatcattttgggaaaacgatcgtcaacagtttaaataaagagattaacgcagagggatatgctggcggtaaattggtctggcataacgatgaagctggaaatccatttagccctggatttgatgagaatgacaaaccaattttcttcctcccatcaggaggtatgttccaggcaaaaaataaaagtgaattgcttggtttttattccagattgcggaggagtggatacactccagagcatagtccaatttttggtttttaagttgtagttaagcattactaaccgaaagatagttatattcagaaatggatataactatcctaaaaaattcacacgctaagcccctcccgatgtaagccatacgctaatcttcatgataaataccggtagcttccataacgagacgcgcctgttttgggtcgcgtttttgcatgaccaaccagtttatgacggcctctgccgatgagatgccattgggtaatgattttgtttttcgtttaccgtccagcccatcagccaacaaacaaatatccagcgttgccttactgacatcaatcccaacgtgatacagggtttacctcctttcacagaaaccatcacgcctgttttgcttgttcattcagagtcatagctcttggtaaccgttcaagatttatgctggcgtgaaaggtgaaacagagagggttttctacgactcaaggttttcccttagcggcgttttgatgaaactctctctgtttcagtgtggcgatagctaatcaccacaggggttaaaatataagtggcgtaagccaccggagcgccccgaggggcggtcaacccttcactcacgaggctaaaaatagctttttcaataacctcaaaggagccaaagctcctttttataaggtgactgaattctattatttaacctgaacaccttctactgacaggatcaattcgacttcttgagaagctggtcctaaatctgtcgtaatattgaaatctttcaacttgatgttaccgttggcttcaaaaccagcacgataacccccccatgggtcgttaccctgccctgtcagtttactttccaacgtcaccggtttagtcacaccatttaacgttaggttaccgataacagaataaccatcaccatttttcttcacttcagttgactcaaatgttgcctgtgggaatttagcaacatttaaaaaacttttaccgcgtaggtgtttatctcgttcagcatgattggtatcaacgctattggtgttgatcactacattaactttatcagctgcaggatttttatcatcaaatgtgaaagaaccatcaaaatcgttaaagctgccatataaccagctataacctaaatgtttaatccggaattcgataaaagcgtgttgcccttctttatcgattttataatcggcagctacagcgctaccggcggtaaacatcagtgcgccaagactcaggcccaacagggtcttattaatcatacgaaattctccataatgcagtaagttaatcgatgctacgtcctagcatccgtttaagggtaatatcaccatcgataaagtgatgtttaagtgcagctaaaccatgtaatagtgatagcactaccacagcccacgctaaatagagatgtatagtgccagcggtatcagcctgatcaggtaacccggccaacgttacgggtatagcgaaccagccgaatacattaataggttgtccgtctgcagtagagattaaataaccactaagcatgagacaaaacagaatgctatataacattaaatgggccaagacagcactgacccgggtcaagcggttatagctcgataaaggcttaggtggcggtgagataaagcgccagatcaccctaaatagcatcacagcaaaaaggatgcaccccacgcttttatgtatttctggtgcctggtgataccaaccatcatagtagcccaaggtcaccatccatagccccagagcaaacagtgcatataccgttaatgcaaccaaccagtggatagcaatagtgatatatccaaactgctccctcgtattttttaaaagcatagagattcccttttgcttgattcataaaacaacattcaaacattattaaacataaaatcaacatttattttatataagatatattcctctaattgctgtcaattattttgctgaactctataattaatcaatcagttaaattgttgttctttacttaacatgacataagcacagtaaatacacagcatgaaaattaggctgatattttttcatctctatttccaatgcgctatccaatagcccaatgttgattaattttgagatccactgtcttcaactcaacttaaatttatataaaaatcaacttgctgattaatatacatacagtctgaataaataatatatatgactgagttattacacgcagcatagacaaccgcatcactcactagatttgggcaatacggcaaacgtagcggttatgaaatatagaacgccatgccttcataacacacagggagcgtggtgctgtacaatcggttacatgtacaatcggttacaagccgaaactaatgactcactgaagccttgcaaggttttctctactctgattataacgacccaacggggccggtatatgaatagaacactgaggaacgaatcatgaaaacagtattggctctgattgttgctgcaaccctgagtttatcctctgttgcttttgcagccgacacagtagtaccgcaaaccacaccaacggcgacagcaccagcaccagcaccagcaccagcagtgcataacgcatcagctaaaaccatgcaccacaaaaaagcacaaaaaccaaacacaataaaaaatacgcataaaaccgcccctgaacaaaaagcccaggcagcccaaaaacaccataaagcggcacatagccacaaagcacctaccgtagtaccagcggctaaatagtcccattgagttggagacaggtgtggctgaccattctcgattgacctgttaaaaatgattcactcaacacccggttctccgggtgttttttatcaggagtgctgacaatgctgcgccgctatttatttgaaattattttctctactttggttatttgcgggctggtcacgctatttttttatttatagcacgaaccttgccgccttcctgcaactcgcgttatttagagtatagttagccatagcataaccactatgagcagctttatcagcaaggttcaaggtgtgttaatggatgattccttagtcagtaaaaaagcaaggttaattatttatgcgtttatttttattattacttagcttgctacttatttccattaccaccgctttcgctctagataaaccgggcggaagtaacagcattgaggaccaaacagccctattttttggtaaagatgatcgtactgcggtaacaaacagccgccaatggccatgggaagcgattgggcaagttgaaacggccagcggcaacctttgtactgcaacattaatttccccacgattggtattaaccgccggccattgtgtcttgactcctccgggtaatattgaccaagccgtcgcgttgcgattcatttccgataagggccactggaaatatcaaattacggatctgaaaacacgggttgatgccaaattaggccagaaactcaaagccgatggtgatggtgatggctggattgtgccacctgccgccgctgcctatgattttgcattaatccaattaacaaatgcagcgcctatccccatcaagccattgcctttatgggaaggtactgcaaatgaactgacaaaagcgcttaaattggttaaccgtaaggtaacgcaagccggttatccactcgacaacctcaatacactttataagcatgaagattgtttagtaaccggttgggcacagcaaggtgttctggctcaccaatgcgatacgctgccaggtgacagcggctcacctctgctgctaaaaaatggcaatagttggtcattgattgccattcaaagttccgcgcccgcagccaaggagcgttatttagctgacaaccgggcattatcagtcactgcgattaataaccgtttgaaaaaattggtcaataagatagccgatacaactcagtaattttaccttagcccgctaaatattatgcgatcttgtatttattgaggtgagtcctttactccttagtcgcataagatgagtttgggttgaattgaaaaacgaaagtccctcctagtgctgcggcataacggctcaaggtggtgaggttaggtgaaatgatgcctttctccatacgactgatattttgttttttcagccccgcccgcagtgcgacctcttcttgagtcaaattgcattgttggcgggccgctttcagttcagtcatcatcgcttgccgaatttgtaaatccgtataggcgtcattcacctgcggatgactcaacgctgctgctttaaccactgcaaaaggaatgatgtcaaaatcgtctgtttttttcatgactgcaatctccgtttgagttctttcatgcgccgataagccaatatcagtgtccgtcttggggttttctgtgtttttttctgtaggaggtgaatgatataaacctgccgatggaggtggcaaaagaaaaaaccacgcccgataccttctttagcgcttacgcgtaattcttttaacccctgccccatatcccgtacataaggctctctcagttcatgaccacaagcttcaagctcatccatcgccttaatcagtaccgcctgtatgcctacgggtaatcttactaactccctctgtgccaaccgtaacaaactaatcttatacataagccgtccctgctccgtgaaaaacggtatcaaactcaccataggtaatcaaatatggtgacccagaatcagacaaactttcaacaaccgtctgatccctcagcgcaggtataccgccagtcattaagttgatgcaataacctggcggctacagttcagggttaattattcattcacgggcggtttcgcataaaaaccatcttgtttcatcgattacatgctgtctttatggggaaatgataaaggggaatgatattgaagaggcgataactcactaagaaataaaaagaattcgacgcctaagtctagatagctcaggcgtcgaataggggcatcaatcagacagaaagctgttcgatcgtttgtaagatacgtttgtcagacaccggataaggggtgcccagttgttgagcaaataaactgacacgcagttcttcaatcatccaacggacttctttaacctcttcatcttgctgacgtttaggcggtaatttattcaaccactgttgccatacttgctgaacatgctcaattcgcagcatttgcgccctatcgcgatgaggatcaaccgccagtttttctaagcgccgctcaatagcctttaaataacgtaaagtatcaggcaaacgcttccagccattactcgtgacaaatccacgatagataaggccagcaagctgagctttaatatcagaaagcgccaatgccagtgaaatatcgatccggcctttcaaccgcttattaatactgaacaccagcgtgaggatctgctcaacctgcttggcaatatccaccacggtgtcattcagttccgcacggactttttcttgtaaacgagcaaaatcagcctcctgccaggccgggccaccatgctgtgccaccagtttatcgacgccacaggcgatgcagtcatcaatcagatccattacgttgccatacgtattgaaatagagacccagtttggatttattcggcaatttctcatgtaagtattttatcggcgaaggaatattgagtagcaataaacgccgggtaccctgccacatagcctgttgttgttgcgattctgtatcgaacaaacggatggcaacactgtctttttcatccactaacgctggataggctttgacttcatagccaccgcgccgttgctcatagcagatagggagatcgccaaagctccagatatgtaagttattttgttcaataccatcatccgcgacggcagaaagtgtttcctgtactttctcttgcaactgtaactttagggcggcaagatctttgccttctcgcaaaatacggtttttatcgtccagcacacgaaacgttattttcagatggtcaggcacctgatctaactgccaactatcacgtgacaccgtcacgccagtcatgcggcgtaattcacgctccaaagcctccaataaacccgtttcgagtggtgttacccgtgccagaaaagcatcggcataattaggtgccggaacaaaattacgccgtaccggtttgggcaatgatttaatcagtgctatcaccagttcgcggcgaatccctgggatctgccagtcaaacccctgctcatggatctggttcagaataggtaatggaatgtgtactgtgacaccatcggcatcggtgccgggttcaaactgataagacagacggagttttagctccccttgataccaaaaattcggataatcaagcgggtttactttgttcgcaccctctttgataagcatggttttttcaaagttcagcagctcgggtttcgtctggctcgcttgcttccaccagctatcaaaatggcgggcagagataacatcacgaccaattctttgatcataaaagttaaagagtgtctcgtcatcgaccagaatatcccgccgacgggatttgtgttccaactcttccacttcagccaatagcttaagattcattcggaagaacgcgtgccgcgtctgccagtcaccttcaaccaacccgtggcgaataaacaactcacggcagagcagtggatcgatcgggccgtaattgatcttacgctccgtaacaatcggtaagccgaataaggtcactttctcgctggccattaccgcgccctgagctttctcccaatgtggatcgctgtaatggtgtttcaccaggtgctgggctaaaggctcaatccattcgggttcaatacgtgcagcaatgcgcccccataaacggctggtctcgaccaattcagccaccatgacccacttggggggctttttgaataagccggagccggggaaaatagcaaagcgggcgttacgagcaccggtaaactcttgcttctcaacatctttctgcccaatgtgagaaagtaaaccggtcagtatcgcggtatgtacactgcggtagtctgcggcaacactgttgacgggtatccctaactctttaacgacctgccgcaactgagtgtaaatatcctgccattcacgcacccgtaggtaattcaggtaatcgctgcggcaaagcttacgaaattgtgctgatgacaacgctttttgttgttctttgagataatcccacagattaacaaaggcgagaaaatcggaatctttatccgcaaaacggcggtgtttttcatcagaggcctgctgtttatctaccggacgctcacgcggatcctgaatagataacgccgaggtgataatcattaattcacgtacgcagccacttttctgcgcttgcaataccattctggccaagcgtggatcgacaggaagttgggctaactggcgacccaatggggtcaattgctggtgcccgttactggcggtctgaatggcccccagttcctccagcaaccttacaccgtcttggatattgcgtttatccggtgcttcaacaaagggaaatgcagcgatatcccctagccccagagaggtcatttgcaagatcaccgaagccagattggtccgtaggatttctggatccgtgaactcagggcgggagagaaaatcttgctcggaataaagacgaatacaaataccgtcagagacacggccacaccgccctttacgctgattagccgatgcctgagaaataggctcaatcggtaaccgctggaccttggtacggaaactgtaacggctgatacgtgctgtgccgggatcgataacatatttgatacccggcaccgtgagtgacgtttctgccacgttggttgccaacacaattcgccgcccatgatgtgactgaaacacccggttctgctcactgtttgataagcgggcatacagcggtagcacttcggtgtgtggcaaattttgctttatcaacgcatccgctgtgtcacggatttcgcgctcaccactcataaagattaagatatccccggcgctttcacggcccaactcatcgactgcatcaaaaatggcctgcaattggtcccgatcaacatcatcggcatcatccacaatcggccggtagcgcacctccaccgggtaggtacggccagagacctcaataattggggcgttattgaaatgttgtgagaagcgttgcgggtcaatagtcgctgacgtaatgatcactttcagatcagggcgtttaggtaataactcacgtaaatagcccaagataaaatcaatgttaaggctacgttcgtgggcctcatcaatgatcaacgtgtcatattgcatcagcaggcgatcttgctgaatttcagccagcagaatgccatcagtcattaatttgaccagtgtattttcaccgacctgatcgttaaaacgaactttgtaaccaacacagccgccaagcgaagtatccagctcatcggcaatgcggttagccaccgtccgtgcggccaaacggcgtggctgagtgtggccgataacgcctttcaccccccgccccagttccaggcagattttcggcaactgtgtcgttttacccgacccagtctcaccggcgacaatgatcacctgatggtcacggatagcgttataaatatcctgtttcttctggctgacgggcagattatctggataactgatcgccggacaagccgcccgacggcgggttactcgctgcattgctatcgcgatttcggcttcaatttcgtgagtaatcgcctgtatggcgtcagggttattgatttttcgtgcgctatgtagccgacgctgaatgcgctgttggtcacggagcatcaactcaccaagttgagtggataatgctgtgagcgaagatttcacgttctatattccttattacgtagatcaccgctaaatgcgaaggtccaccattttcatactgtcacttcaattaacagatatcgtttcaattaacggacatattttattcattaagatgtcatttttatccgccaacccactttttttggttcatggtttctattatagagttgatttacggtttctatttagagttgattcatggtttctattatgttgattcatagcttctattatagagattcatagcttctattatagagagtaacatagcctttagtgccgccgtaacccagcctgtattttcgccataatcacttcattcaataaaatcgaacaaagagcgcaaaatattgcgctatcactggtagcaaaatctgcataaagtgtatctcattgaaagggcgtgtcgcctgaatttctgttctctgttaaggaattacgatgagtaaagtactggtcctgaaatcaagcatcttggcaacctcttcacaatctaaccagttagctgacttctttgttgagcaatggcaagccgcccatgcaggtgatcaaattactgtccgtgatttggccgctcaacctatccccgtattagatggcgaactcgtcggtgcactgcgcccttcaggtacagcattaacaccgcgtcaacaagaggcgttggctctttctgatgaactgattgctgaattgcaggcgaatgacgtcatcgtgatagcggcacctatgtacaacttcaacatcccgacgcagttgaaaaactatttcgacatgattgcccgtgcaggcgttactttccgttataccgagaaaggccctgaaggcttggtaacaggtaaacgcgcgattattctgaccagccgtggtggcattcataaagataccccaaccgatctggttgtcccttatctgcgtctgttcctgggctttattggtatcaccgatgttgagttcgtgttcgccgaaggtattgcttatggcccagaagtcgcgaccaaagcacaagccgacgccaaaacattattggctcaggtagtggctgcttaagccgagtgatactcgctcactaggggtgtcaccctaatgagcgagtaaaaagatggcctcgtattaccctcattttacccgaaagccatgtgatgattgcgcgccaaccggcgcgcttttttatgccttttcttccgccagcagaaccatggcactctcttcatcagtcactaaaccattcagccactgccccttcaaagccgctttaatcgcctgatgcttttctttcccgccggcaatagcgatcacgggtttttccggctgaatacgtaatttcacgctggttaagcattgatccaacgcgtacgggacgggttgcccatccgcatcaataaaattacccagcatctccgcgaccacatgcgatgcgagcaaggcatccacatcttgcgccgaaataaaaccatctttgtgtaacgggcaatggtagccaatcgaaccgataccgataaaggtgacatcggcctgcgctgctttttcggtgacagtgcgataaatgcgatggttacaccacaggtcacgatcagcggcgctgtcagcaaataaaggggctggcaggataaaatagcggccttgggttttctcagccatccacaacgggacgtcgtaacgggtgcaagagccgtcagcggcaatggcccctatcaatgatacacagctatgttgcggccgttcaacatcaggcaactcatcgatggcggcctttaaactgcgccctgaaccgacgccaataactaagggttgctcttgtcgtagaaactgcgccatcacctcggcccccgccacggcaattgcacgttgaacccccgcgttgtccatgccttggctagggacaacctggcaacggtgtaaaccatagcgttgttgtaattgctcggccagcgccatacagcgagccacagggtgcgtgatattgacactgaccaatccattatcaatggcgcaagccaccaaccgctgtgcaacctgccgagagacgcctaacgcctcggcaatttcatgctgagtttgcccagcaacataatacatccaggccgctctggccgcctgatccagtttcttatcactcttatgcatgggttatctgcgcattattttttgaagtaacaatattagtcatattacgtcgctatttcgcagatttttatccctacgcacgtttatgtgagctaaagctcaatttgagggcaaaagttacattaacctacacgaaagggcaaatgcccaaatattgaatttatgcccaaacaataactgtagcaccttctgtaattgtggagattattatgaatactgacctgaaatcaccccctgctgtgtggctgcatattggtgctggctccttccaccgagcccatcaggcttggtatttacaccgtttgttagcctcaggcgatgaccgttggactatcgctttggccaatattcgtgatgacgccatcccactactggacacattgcgggcgcaacacggtgaatatgtcttggaaacggtcacaccaagcggtgaacgccagtatgaaaagataacatcactgcgcaatatcattccttgggataaagcgctagatcatctggtagcgcaagggagtaaacccgaaactcgcgtgatctctttcaccgtaacggaggggggctactatttagataatcaatttaatctgcaacaggacaatagcgatattcaggccgatcttagaggagattgccgcacgatttacggggcaattagccgtatcttgcaacaacggcaacaggataagagtggcccggtcactctactgaactgcgataacttgcgtcacaacggtgaacgattccgccatggcttattagagtttcttgctctacgaggtcaacaaagcctattaaactgggtgacaagccagacccgcagcccgaataccatggttgatcgtatcaccccgcgcccatcagccgatatcgcgcagcgggtgttggaaaaaaccgggatcgtagataacgctccggtgatgggggaatcatttattcaatgggttattgaggatgattttattgctggccgcccggcactggagagcgttggggcggaaatggtcacctcggttttgccttatgaagaagccaaaatccgcattctgaacgccagccacagttgtattgcttgggcgggcagcttgattgggcaatgttatattcatgaaagtacccaaaccgacgctatccgccagatggcttatgactatgtcacgcaagatgtcattccctccctgacgcccagcccacttgatttagcccattaccgcgatgtggtactggaacgtttcagtaatccgtatattcgcgatacgaaccagcgtgtcgccgccgatggattttccaaaatccccggatttatcacccccacgctgatcgagtgttaccaacgtggcggagtgcctaccgctaccgcaatgttgcccgcattattcttcgtatttatggaaagttggcaccaaggcactctgccgtatgaatatcaggatggtattctggacccagcagccgtccataccatgtttcagtcttctgaccctgcaggcttatttgcccgtgatagcgcccttttcgggccgctggccaatgatgatcagttcgaacagttattacgccagtccataaatcgtgtctctgcttgggttagcactaaccgttaatccctgaggagggccttggggggcggcgcgtttagggggcgggggatctccggtgataaatgatcgtcagtaattaatgatcagccgtaattaacgatcagcagtgcagtaatgaactacaggccggtacgaagccgcccattgttcaacgtgttatccctgatattatcggcaggaggatttagcgtttcatccactggccattaatcccgcgcacatattcgccctccgccgcgcggttgactaatttctgccccgccaatttggcgacattctcggttgagatatggtttttttgcgccacttcctgatacttctccgctctggcaagattgatttgctccaccagcgccaaggtttctgcatcttttttcaccggcgctaaatagccactcaaggtctctcccacccggccttgttgttttgcctgttctaatgtcaaagcgaacgagtgcgggctgtacagtaaactgctggtcaacaccaaacaccccaacgcaagccggatcagactttgccgcccatcaatccagcctaaagtatgctttttcatgatggttccttagaagagattggattgatttttaagcaatgcttccacatctttatcgacccttatctggatttcatgctcaatcttgacgttcatattaatcgtgataggtttctctggtgtcgctacctcaagacggacacagccactgagcagtaaaatacccagagccatcgccacacgctcccctgtcaaaatcttcattccttcgccctcgtcggtattggtgctgttggttgtgatgaaatgccttgcggtaatgaactcgcggacggtaatgaactcgctgatggtaatgaaatagtctgttgcaaccactcttgtaaattgtcaccaaatcgtaggctgcgccaaagttggaacaggttctccttgtgctggtaattcagtactaccgcccgtgtgctatttttttgcgaattcacaccatgaactttagaggttagcgtcaactgccccagattatccagatccactttggtatacgattgagaaatctccatgtaacgcaaccagtcaatcgccgcaccggcgacagtattgctctcactgatagaatcggtcaggtctttatcgagccgtaatgtcagcatgccgtcattggcaatccaaccattacgcaccagccactgtgggttattaagataaagcggtaattcgccgttcactttacccgacatcgcaaattgcttcggttgtaatacggtgaacaacgcgctcagatcaatctgacttaatttgaggacggcggcatcatgttgtggcaaacgcagcgcagacaagctcaggtggccgttcaaaatatccatgccaacattgcttaatgttagtggtgccgtttctgaataaggataagtcccctgtaaatcagcagtaatattctgcatatcaaagaggttattcaacgaagcgatacgtagcattaccggctctttagcccctaactgccagtgatggttctgtaaacgatacgacatgacaaaatctagcccgcttaactcaccgtcctgcaaccacatgccgccattgtttaccacccaatgcccaccggcagtaaacccttgttcacgcgccgcagagaatgcggcttgcgcataaaacgtaccgtcccgcagtttgatccccagatcttttgaaatcagtggctggaagaccattaatgactgcttaggccaccaaccctcaccacgcaagcgctcaccatcccagcggccacgtagcggaattggcccgatagactgagcttgcaattgcccttgccagaggaaactatcgagatcgcggccattgaattgcagtgataacactgacggggggagataaccgccaccatcactgaactccacttttttagcgctcagtttcagacctgcaataaacgcggggtggtggttatctcgttgccaggtcagcggtttcgtcaatatcaaacgtggtgcgtccaccttgactaggccatattgtaaacgatcaaaccccgttgacagcgtatccaccgtaatcagcgtatcccgccaactccccgtccctcccacatcccagcgtgccgctaatggtggcaagtttccgctcccccaatagcgccattgccaattgcccttatctggccaaaacgcttgtgcctgcccatccagatgcagattgacactcccccagtagctatcctgagcatcaacgattgcctgtaaacgccccgtaacacccgcggcggtcacccggatacccgccagcggccaacgagcatcttttatccgcaattccggggtcagattaccataagtacgcagcaaggcgccgggggacaatatccacgtcggattcaatactgaaccgctaagtaaaccggggatcgtggcgttaaacaccatggtttccagatttacttgcccacttagttggaattttaactcactgttaattaaacccaaattgcccggccccagcgtcaatacggcgttccctttgccatttttccccgaggtaatcacgttaatccgtgcatcaatcgaggtctgttccaatccttgatcccaatcgtgtagtgtcaggttaacgccccccttcaacggctgttgaccatatggccattgccactgaccgttcacgatctgaataagattcgccgaggcttgccagggtaaacgcgctaaaggttggttatcgccacgctcagttaaggtcaatacgccctgctgttgctgccaactcaagttcaatagcagcggcttcgacaaataaccggtggtcaatagcccatctaatgcgccttgctctggccactcatccaatgacaacgggattttaattttaccgctaagctgaaacagttgaggcataccgggaatggccatagagaactgattcaaactaagctgctgttgttcattcaacgtcacagcaaagctgagttgctgcccctgataaccgagtgtctgaagagatttattgttgtcaggtgatgtcagtgtcagcttgcctgcatattgctgccaaggggtgaccagcagatgattgatagtaagatcaaaacgggacagttgctgctgccattgcgccaaatcgagcggagagctatcaccgccagacggtaactgactcaaacaagcagtctccagcaccacatcacccgcacccaactgccagcgtccttggtgataacctatactcagttgactgatattagcgagcgtacaatcctgagccaaataacgcagttgctcgacacgcaacgcgccattacgccacacaggaagaacgggtaattgcagttggctacccgcaggtaaccaatacccggcgactctcggtaaccatgtcggcagagttttccataacacgagcagcgacagtgcgcttattaataacaacccgactactatttttgcgcatttagccatgacttgccttgttttatcaccaacctgacactgagtgcttcaatcactgcgcccaaaaaccaccaagacctacaataactgagccctacattgcggcaagataccataataactaggtaacagctgtgattgaaaatggagataaacaccttatccttttagtcttaataaattacacagactgcgataaacttatcattgctgaaaattgtatgacttattgaaatatgttaaatttatcacaatattttggcggagaaatacgatgaaattagccgtttacagtaccaagcagtatgaccgtaaataccttgagctggtcaacaaagattttggctttgaattggagtttttcgattttctgcttacccccaaaaccgccaaaatggctgagggctgtcaggcggtatgtctcttcgtcaatgatgatggctgccgcgaaatattaactgaactggcgactatcggcgttaaaattctggcattgcgttgtgctggctttaataacgtggatctggaagcggccaaagagttgggtatacaagtggtccgagtgcccgcatattcacctgaagctgtcgcggaacataccgttggcatgatgctgagccttaaccgacgtattcaccgtgcttatcagcgaacccgtgatgccaatttctcgctggaaggcttgattggtttcaatatgcataaccgcactgcggggattatcggcacaggtaaaattggtgttgccaccatgcgtatccttaaaggttttggtatgcgcctgctggcgtttgacccttatccaagtgagcaagctctagagctaggtgcagaatatgttgatctgaagaccttgtacgccgagtctgatgttatctcactgcattgcccgatgacgccagaaaaccatcatttgctcaataagcagtcatttgatcaaatgaaagatggcgtgatgatcattaataccagccgtggcggtttaattgattcaacggcggcgatcgatgcgttaaaacaacagaaaataggctccctcggcatggacgtttatgaaaatgaacgtgatttattctttgaagataaatccaatgacgtgattcaggatgatgttttccgccgtttgtcctcttgccataatgtgttatttactgggcatcaggcgttcctaaccgaggaagcactcaccagtatctctgtcaccaccttgcaaaatattgctcagttggataaaggcgaaccctgcccaaatatcatcaccctctgatgcattaacatccaatagcggatagcgagtgaacattctccctatccgttatgatgagtaggagataatatgagaaagttcgttccagtggctattatcggtgtacttctggcaggatgcagcggtatgaatcagtctgggaataatatgaaccctgtgacaaacagtagccatgtgaccgaaagtgacctgttacaccataattttgtcttggtcagcgttgatggtaagccaccggttaaaacacctgaacccaatattgagtttggtgaaaatatgcatatttcaggtgcgatgtgtaatcgatttatgggccaaggtgaattaaaagacggcatattgacggctaaggggctggcgagcacccgtatgctatgcgctgatgaacaactcaatcaatgggacgcactgattggtgatatattacacagcggcgtgaaagtgaccttaaataaagggcaattgacgatgagtaatagtacgcacaccttagtttaccaacagaaagattgggttaactgatgctcattgatgcataacctcttatttaggcggcagttttccgatagctgctgccaattaacgcaccgggcatgcaccgcgcaacaacgcttcctcgtcacaacgtttgccatccggtaactggcacatgcctacgctaccgccatgaagttgcctcgtgttagccaatattccccccgcattagcacaattagctgctgccgaattggacatattgacgtcatttgacatattcacattgcgataagcgatagcgttggtagcctgctgctcgggttcgtaggtcttgctattatttaacgtattgctattatttaacgtattgatatttgaatcattgctgctacatgcggctaaaaatagcgccataccgcacactactccctgaaatattctcattcttttgctccggcaggatagacttatcaacctataatttataaatctagctagtattatgtagtacatcaccctatttagtacatcacgctattgggaatagatgaagcacgacatgataaagatattcccagtataatacacaactcatccaatattcgggtcagtcaatcattcgatatgtcatctctgctaacttcgcggtagcgtcaaggaagaaaggtgtagtcatcggttagaagagcaggtatctatagtctgtaaaaaataaaacgggaacgaccatgatcactgatttattgttacgaattaccctagcggggattttaggtgggttaattggtcttgaacgtcaattacgggcaaaagaagctggattacgtacccatattttagtcggtattggtagtgccatgtttatgatcgtctctaaatatggttttgaagatttattggtcttagaacacgtcagttttgaccccagtcgagtcgccgcacaggtggtcagtggtatgggttttcttggtgccggtaccattatgattcaaaaacaaatggtcaaagggctgacaactgctgccgggatgtgggttacggcggctatcggtctggttatcggaagcggcctgtatgaaattggtatttatggcaccttgatgaccttagtggtgctggaagtcttccgccaattaagccagcgcttactcgggcagcattattatattgtcgtcaagttactccctgaaagcgtcccattggtgttggttgtactgcaaaaattgcatttacagcccatgaatctctcggtgacacaaaaccataaaagcgataatactagcagtgaattgacgatggaagtgacgttgtcacccaaaaagacggtaaatcaggtttatgaacaattattagctattgagggaatacatcagttagatattaagtagcacgtttggctccgcgttatcgtccaatcaacggtaacgcggaaaataaggatgtcagattaatgcatcggtgtcttggacaggaggttaatcaccataacacccgaaataatcagcgccataccgacaaccgccgcccaatccagcttttgttgatacataaaggtggcagcgattgagaccagtacaatccccaaaccggaccaaatcgcataagcaatacccagcggcatggttttgactacctgcgaaagcccccaaaaagcaataccataaccaatcacgaccaccactgaagggactaatcgagaaaaaccatcggatgcttttagcatcgtcgttgcaactacttcggcaataatcgccataaataaatagacaaaactgctcattatcattctctcatttcaacataagggcgacattatgcccgtacaaagttaaatcttcattaaattgacaccggcttcacagcggctttacaagtcagtgagttggcaagctaatcaccttgtaaataaagttttgtataaaaatcaccttacccctcctcttttattgccgaggccataatgattacgttaaacgacaatacgatattgctgtaaagccaccaataatctgcaaattgttaaagattatctgaaaatacccctatcacagccctctcacaaataggttcaccttgcattttattgaactgtatttggtgaattcagtcacacaaacgcgataactggcaaagaatatcttctgctaaaattttagcattagctcaaataatgaattatttcaaagaatattttagcaatcagagacccccattacgacgttttctctgtatgaaaagcaatgtgaaggtataaattaatgattacgactgacggcaacagcgcagtggcttctgtggcctatcgtgccagcgaagttattgctatctaccccattacccccagttctacgatggcagagcaagccgatgcttggtcaggtgacggcaaagtgaacatctggggcgatgtgccgcgggtggtcgaaatgcagtccgaagggggggctatcgccacggttcatggggcattgcaaactggcgcattatccacctcctttacctcctcgcagggattgttattaatgatcccaacactgtacaaactggctggcgaattaacaccatttgtacttcatgttgcagcccggacaattgctacccatgcattatccatctttggtgaccattccgatgtgatggcggtacgccaaacaggctgcgccatgttatgcgccagtagcgtacaggaggctcaggattttgccctgatttcacagattgccaccctgaatagccgaattccctttatccatttctttgatggttttcgcacctcgcatgaaatcaacaaaatagagccactcagtgacgagacgttgcgccagttattgcctcaagcagggattaatgcgcaccggagccgggctctttcgccagatcacccggtggtacgcggcacctcagccaatccagatacctatttccagtcacgggaagccactaacccttggtataacaatacctatcagcatgttgcggatgccatgcaggcatttgctgaagccactgggcgtgaatataaaccgtttgaatattacggccatccacaagctgaccgtgtcattattttaatgggttccgctatcggtacctgcgaagaggttattgacaccttgctcactcgaggggagaaagtcggtgtgctaaaagtacgcttatttcgccccttctccgcacagcatctgcttgcgctcttgcccgcgtcggtcggcaaaattgcggttttggatcgcaccaaagagcctggcgcattagctgaacccctgtatttggatgtaatgacggcattagctgaagcttatagccgtggtgatcgtgatacattgccaaaagtcattgggggacgctatggcttatcctccaaagaatttggcccccattgcgtattggccattttcagagagctgtcattagacttaccacgcccccggtttacggttggaatttttgatgatgtgaccggcctatcgttgcccctaagcgacgaaaaaattgaatcgcgcgcaacattggaagccctattttatggcctgggaagtgatggttcagtctctgccaccaagaataacatcaagattatcggcaacagcaccgcactctacgctcaaggttattttgtttacgattcgaagaaggctggaggcctgacggtctcacatctacgcgtaagccagacgccgattaactcagcctatctggttagccacgccgattttgtcggctgccaccagctacagtttatcgatatttatcaaatggctgaacgccttaaacccggagggatattcttactcaatacccccttcagcgcggatgagatgtggccacgtttgccacaagacgttcaggcagtattgcatcagcgccatgcccgtttgtttgtgatcaatgctgcgaaaattgcccgtgaatgcaaactcggtgcccgcatcaataccgtcatgcagatggccttcttccatctgacacagattctgccaacggccatggcacaagagcaattacgggccgcgattgaacgcagttacagcaataaaggggcagaaattgtcacccgcaactggcaggcactggatgcaactctcgaagccttaattgagatcccgctgcaacctattgacgaaaacagccctgtacgcccaccgattgtttcagaccaagcgcccgatttcgttaaaaccgttacggcaaccatgctggcaggcttgggtgatacgctgccggtatcggccttcccgcccgatggcacctggcctgtcggtaccacccaatgggaaaaacgcaatattgcagaaaacatccccatctggcagccagacctttgtacacaatgtaatcactgtgtcgctgcctgcccacactcggctatccgtgccaaagtggtacaacctgaggccatggccggtgcgccggacagcttacagtcactggatgttaaagcccgtgatatgcgtgggcagaaatatgtcttacaagtggcgcccgaagattgtactggctgcaacctgtgttatgaagtctgccctgccaaagatcgccaaaatccagaaatcaaagcgattaacatgcggccgcgtctggaacaccgggcggtagaaaaagcacattatgatttcttcctcaagctgcctgaaatcgataaaacacaaatggaacgtatcgatatccggacttcacaattgatttcaccgctgttcgaatattccggagcctgctccggttgtggtgaaacaccgtatatcaaattgttgacccagttgtatggcgatcgtctgctcattgccaatgccaccggttgctcttcgatctatggcggtaacctgcctaccacgccatacaccaccaatgccgatggccgtgggcctgcatgggcaaactcattgttcgaagataatgcggagtttggtttaggctttcgcctaaccgtcgatcagcatcaaaaacgtgttacccggctgatccaacagctagcacctcaactgccggatgagttggtcaatcaacttatcaatcaggaatacaccccagaagagcggcgtaagcaagtctcacaattgcgtcagttgttacgtgagataccaggcaatgatgcacaacagttagcagcagacgccgactatctggtggataaatctatctggctgattggcggtgatggctgggcatatgacatcggttttggcggtttggaccatgtcctgagcctgacagaaaatgtcaatgtgctggtactggacacccagtgctattccaataccggtggtcagcaatccaaggcgactcccctcggtgcggtcaccaaatttggtgaacacggtaaacgcaaagcgcgcaaagatttgggcgtcagtatgatgatgtatggccacgtctatgtggcacagatctctattggggcacagctcaatcagacggtgaaagccattcaggaagcagaagcctatcccggcccgtcactgattattgcttacagcccttgtgaggaacacggttacgatttggcatacagccatgaccaaatgaagcaattgacggccaccggtttctggccattgtatcgctttgacccgcgccgcgccgatgaaggcaaaaccgcgttagcactggattcacgcccaccaagcagtgacttgaccaccacactgcttaatgagcaacgtttccgccggttaaatacgcaagaacccgccgttgccgcccagttatatgccgaggctgaaaaagatctgaaaaaacgctatgacttcttgagtttactcgctggcaaaacggaaaaaacgccttcggaataaacagcactctcgtttaccctgtgcgatttactgagccagttagctaaaccgctaactggctttttctattatcttgtatcttgatttttttatattcttgtttttagcttaaacgctgtgtcggcgcgtacaaaagtggtttttagagaaagcaggctgcacaaatgttgtcacaacagtagccttctatcgggcattgcttgagtgctattataagggacataggtcacaaccgcccccattatgcccctaactgaatatgagttacgaataaatgctagaaaaacaatcggttaatcagaaagaacaatacaattttaacaagctgcaaaaacggctgcgccgtaacgtcggccaagctatcgccgatttcaatatgatcgaagaaggtgaccgtgtaatggtttgcctgtctggcggtaaagacagctataccatgctggatattttgcaaagcctgcaaaaaagtgctcccatcaatttctcgttgatcgcggttaatctggatcagaaacaacccggttttccagaagatatcctgcctgcttatttagataaacagggggtggaatacaaaattgtagaagaaaatacctacgggatcgtaaaagaaattattcctgacggcaaaacaacctgctctctgtgctcccggctgcgccgtggtattttataccgcacagccactgaactgggtgcgaccaaaatagcgcttggtcatcaccgcgatgatattctacaaacactctttttgaatatgttttatggcggaaaactgaaaggtatgccacctaaactaatgagtgatgatggcaaacatattgtcatccgccctctggcctactgccgtgaaaaagatattgagcggtttgccgttgccagagaatacccgataatcccatgcaacttatgcggctcacagccaaacctgcaacgtcaggtcataaaagatatgctacgcgactgggataaacagtatccaggccgtatcgagaccatgttcagtgcgatgcaaaatgtggtgccatcacatttaaatgaccataagttatttgatttcaaaagtattactcatgacagcgacattattgatggcggtgatttagcctttgatcgggaagcgttgccactgaacccagtcggttggcagccagaagatgacgaagacacagaaaaacgtccatcagtacgccttgatgtgttggaaattaaataagcggctcatcagtccagcctcgtttcgtttatgacatggaatgaggcgcattatttgccctgccctccgaaaatcccttttctatcagaatctttgatcgtgtatacgaccctttcctccgccacaacagacaacgcagctttctgagtatccacggcatgtgggtttacgaacatattatttcaagataaacatttagctaccccattgactatagagtaactctatcctttatattgatttggcataaaataacagaggtcaaacgtcatgaaggtatctataacacttccgtctgcattgttaatggcggtcttcacattcaatgcagaagccaatgtgcccaaaatgcctgctgattggcacggtggtgagatttctggcccaccacaggcgccaaatgcctgtggtgaagcaccagatatttcgcgaataaaaaataagtacttagatgtcagttatgctaatgcatcaccatcagaaaaaatggatatattcctccctgaacagtggaaattgcgttatccggttattattaatgttcatggcggggcattttttggttgtgacaaaatggataaccagttaacgcctgctctttatggcctttctaaaggttatgctgtcgtgaatattaattatcgtttaagtccagaagcagcctggcctgcgcagattaacgatctcaaagcggccataaaatttgttagagccaacgccataaaatataattttgacccagataatattattttgatgggggggtctgctggggggaatcttgttgccttggctggggtttccggcgatgtaaaatccctggaggatccaaaattaggttatccagatgtatcaaccaaagtgcaagctgttattgcatggtacccacccattgactttttaacaatggatgagcaatggaaaaaaattggtattgacggacagaaacattcaacagagaattcttttgaatctttccttatgcgggaaaaaattacccaagtagataaatcccgaatgtccaccaccaatccgatgaattatattaccgcggatgccccaccattcttaattcaacatggttaccaagacagtactattcctcggttacaaagccaactttttgcggccaagctcgctagcgccataggtagtgataatgtagaatataacctactgatgggtgcagaacatgccgatgataagtattttcattctaataacaatttggaacgtaactaccagttccttgcccgccatattcatagccagtaaaaatagtgggccaaatggcccactgatgttattggcaaagtgcccatggcggagagaacaggcagaccgtaaagatgcctgcttccctgcataaaaatagccttccatgggggctagatccgcgccactactggcgcggacgctttactcttctgcctatcctcacagttcacgttcgagtcgtcaagctttgtcagccgtctgaatgagccgaatagcccactataaaaataattcgagattcaggtaggcggcaagagatataatccattttcaagttaaccatgttgttgatatgagtaaattagattatgtataaaataaaaagattctctcaaataacggggatttctgaatttaatttacgctattttgaccagattggtctactgccagctgaacgtgataatagtcgttatagactctatcacccacggcaaatcgccatggctcatttgattttaagtctacaaaaagcacatgtttctaatgaaaaaatcaagagcatcttgatggattactcatccaaaaatagccagtccgcattatgttacgcacaacatgctattgatgagacgttgcaccaattaacatgtgccagacatttcctcacaacgcaaattgagcgtcagatgctcatcaatgacgccaaacgtcgattaaataatccatttattgaggaaagaaatatcgaaccgctggggatattctcgataaatacgcctaacattatcgatttttttaaatatgtctctgaagtatcaggaaacccggattggtatttacgtcatcgctacggatttattgttgaaagagaatccattcaaaaaaacaactataaattaatgaattttttctgcaatgagcctaatataatcaataaacatggtggggattttccagctggaagttattttagtggtttttataaaggaagtttggaaaataacccagcggtatctaaacacctatcgcaagcggatgataacggaatgaaccattcgtctaaggttattattgaacatatcagtggtccagccacagttaagtgcaagagtgaattcctgattaaagtgatgtatccctgccatcatcaactggacgggtcccacgagacaccaacagtattgactccttcatcaacaaattaagtatttgccttatgcacttcatgaccatggtgtagacgaggaataagcatcagatcatccagcatgggcaagtactcagatacaggtcgggcagatcggtcagatttacgtcacagcgcaatactacgcgccatgcccggcgcacaaaaaaatgccgatgtttttcaacatcggcaccgtaacaattaaatgctatgcagtaattcaaaataaaagtataacaaatatggagcgcaacgcccatcgcttgacgttgcattcacctgcaaaataatcatgcctgagccaccacaacaaagtcttgatgtggctcaatttttcggtgactaatcccaccctgcacgctctattttcttcggtgacgttcagtcaactaaagccatttactgcgctttaaccaccaggcaacactcaataccagaacgactaacatcatacaaaatatggtgaaaccgaaagcatcggtattaccaggtatccctcccagattgacgccaaataacccagtcagaaatgttgtcggtaaaaacaccatggccaagagtgacatggtataggtacgtcggttcatggcatcagccattaatgaacttatctcatcagacaaaactgctgtccgggcaatactgccgtccagatcttctaaaccacggcctaaacgctccgatatttcctgcatccgacggcggtcatcgtcattcatccacggtaaacgctcgctcgccaaccgggaaaaaacatcacgctgtggggccatatatcttcgtaatacaatcagttgtttgcgtaataacgccatttgcccacgcggtggaactttttgctccatcaaatcatcttccaaatcaatgattttatcgtgcaagtcttcaataaattcgctggtgtgatccgtcagaccatcagcaatatcaaccaaccaatgaccgctacctgttggtcctgtgccgctttgtaaatcgtttaatacattatcgatggaatacactttgcgatgacgggttgagacaattaatttatccgtcatataaacccgtatagtgaccaactgatctgggcgggcatcattattaaagttgataccgcgtagcgttatcatcgtgccatcacccaaacgggtaattttagggcgcatactctcgccagcgagcccgtcgcgcacaacctcaggcaataaaggcgtattttgtagccattccgcactctctggataggtataatccaaatgtaaccaacaaggctgcgtagcactggctaccgcatcgacactgatggccgtcatcccacctttgccatcaagctgataagcatagactgcatcagagacttgaagcgctttcccttcgactacatccacaacagcatcctcttgtttaacattcatcatgcaattagctcagtgtagcgctagcaacccgatctttaaaggtaatgagccaaggataaccctgggtgacgttataaaatattcgctgatattgatgaaacgtgggtaagccgagacgcgaaaataattatgaataaaggacaagaataaatgcaaaggcggatttaaaatccgcctctgttaattagttaaaaacaataagcccataactatcagtgcttaataatatataagttctgactgtaagcaacatcttctggattggttatcgggtaacctttcacccaggatttaattaaacggccattagtaaattgatatatcggtgcgatagggacctgttccgcaataatttgctcggctttattataatcagcactcagtgctttagcgtttgtctgcttacccgcatcggccagtaaacgatcgtaatcagcattattgaatttggcaatattcccgctatgcctggatgttaataacgacagaaaagttgatggctcattataatcacctatccatgatgctcgcacgacatcaaaattaccggtattacggctatcaatataggttttccattcttgattgaccattttcacatcgattcccaaggtctttttccacatcgatgcgatagcaatagccaacttctggttattatcggaggtgttatacagcaaggtcagtgttaacggtttatctgggccatagcccgcggcatgaagcaaagatttggcttgagcatttaactcctcttggctctgttgctgcaataagctcgccgccggttcatagcctgcggtgacatctggggtaaagtgataagcgggtttttctccggtacctaataccttctcagcaataatttttcgatctatcgcataagataatgctttacgtacccgaacatcattggtcggcgcgcgttgagtattaaaagcataataataagtccctaactgatccggggtataaacttgatcaggaatatcctttaacagtttttgatacaaattcttcgggaatgactccgtaatatcaatatcccctgccagatagcgtttggtagcattcgcttcttggctaatgggaacaaaggttactttggtcagaacagtgcgtccatgatcccaataatactcattaggaacaaacactaacttttcattaacgactcggtcttgtaatttaaatgcaccgttaccgaccaaattaccgaccttagtccaattgttaccatatttttcaataacagattgtggcacggggaataaactgaaatttgcggtcaggcttgggaaataaggaacgggtttactgagtttaactttcagggtgtaatgatcaatcgcgctcacacccagtgcttccggtggcatttgaccggaaataatctgttgcgcattctccattccggccagttctgcaaaccaggcaaacggagacaaacttttaggatcgaccaagcgacgccagctgtagacaaaatcttgcgcagtgacaggttcaccattggaccatttcgcatctttacgtaaggtgaagatataggtttggttatctgctgttttccagctcaatgcgacaccgggaataggctgcccatgggcatcttgattaaccagaccttcaaacagatcccgtaccacctgagcctctatcaacccaacggctttcattggatccagcgatgctggctcatctttaatatgccgaacaatttcttgtttttcagccaataccgttccaggagggacctcagccgcatttgccgctcccagtactgaaccgactactacggcacataatgcataacgaaaatagtgcatagtcgataaccttatcgttgttgttccatatcagcgaaagtagattctcaatacctagcctgctggccaacacaccacgtaggcaatactcaggccagtccttaggtccatcattctcataaatttaacgcatcattattttcaaatctattttagttacggcaaatcaagttacctatatttaacatcaaagcagcacaatgagaaagacataaactcgcagattagacgctggcgtgacgacgataaattcgtacaatcttcctgcttcagcctattggttatcgcattttatctgtcagttcttcgagctaatctgtcggttcttagaaccaataaaattatcgtgccgttccccattcatgttaacaatttgaatgatgataaacgaagtgataatttcttacttactgaatctgaatagtggcactataaataccatgaatgctcttcgcccccgcactgcccgcggtaattttatcgtttcaggccaacaatacggtcaatctctgctgggtagcccgctactttacttccctgcgtctcccccctcagtgaatattggcttgattatcgcagggactcatggtgatgaaactgccgcggttgttgcgttatcctgtgctttacgcagcctctcaccgcaacaacagcgtcaccatgtggtattggcggtgaatcctgatggctgccagttagggctacgggcgaatgccaatggtgtcgaccttaatcgtaatttcccagcccaaaactggcaatcaggcgatactgtctatcgttggaatagtgcggcaaatgctcgcgacgtggtgttatcaaccggcgaacaggccggttctgagccagaaactcaagctctctgcgcattaatcgcccagttatcaccaagttgggttgtttcgtttcatgagccgttggcctgcattgaagatccccaatgctcggcattaggtacccggttggcagagcaatttgaactcccgttggtcaccagtgtgggttatgccactccaggctctttcggcagttggtgtgcagaccgtgatttgccgtgtattactgcggaattgccgccaatttcatctgattcagccagcgaatactatctggctgctttcattgagttactgacgttggcggattaaaccgacagatctatcgcgcgaggtctagcgtgccagtaggtctagcgtacccgtaggtctatcgtaccagtagaaaaatgcagtcccccctctacgtcatttgccaaccaggtcgggccatctaaatcaataaaacgcgcccccggtgctaagggcagtgccgcacggatggcacgagaggtacacagcatacagccgagcataatggcaaagcccatcgatttagcctgttcagccagtagcagtgcctcggtcagcccaccacttttatccagtttgatgtttaccatgtcatagcgacccaccaaacccgctaaatcagcccgcgtgtgacagctttcatccgcacagaggggtaatggatggatgaaattctgtaaactactgtcttctcctgcgggtagcggctgttctagcatcaccacccccaagtcagcaagtaattggcaacgcgctgccagcccttcaggttgccaagcctcattagcatcaacgattaacgttacctctggcaccgcactgcgtatcgcaaccaagcgttcggcgatcaggtgctcatcaagtttgactttcagcaagtgggccccaagctgcaccaatgctttggcactgcatgccatggcttccggagtaccaatactgacagtctgagccatggcaacggtttcaactgccgttatctggcttcgttgccataaactttgctgatgttgcaaacactccagttgccataacgcagaatcgacggcattcctcgccgctccggccggtaaaagtggctgtaaggcttcccgcgagacgccattctcaatagcattagccaccaaagcaagctgtgccatcactgaagattcactttctccataatgcgggtatggagtacattcaccgaatgcatgaatgtcgttctcctcaatttcaacaacgataactttagcttcagtgcggctgcctcgggaaatgacaaacgcggagtgaagaggccaggcctctgggtaaaaacgcactgttctcattatcgctccttggcagaatacagttttagcttaggtatgagaccctcatacgtttatccgttaagtctttaaacgggttttttagcgaacttgctatatccaagctgttgttgttatcttaaactgaaattcgtgttacacatctgtaaaagggacccaataatgacacagaccgtacatttccaaggcaatccagtttctgtcgcaggtaaactgccacaaattggtgataaagcgaaagacttcactttggtagcaaaagatttatctgacgttgccctgagcagttttgctggtaaacgcaaagtcctgaatatcttcccaagtattgataccggcgtttgcgccgcctcggtacgtaagttcaatcaactggctggcgaacttgagaacaccgtagtgctttgtatctcctctgacctgccctttgctcaatcacgtttttgcggggctgaaggtctgagcaacgtcatcacgctgtcaactctgcgcggcgctgattttaaacaagcttacggtgtagcaattactgaaggccctctggcaggtttgaccgcacgcgcggttgtcgttctggatggccaggacaacgtcatctacagcgaattggttaacgaaatcactaccgaaccaaactacgatgccgcgctggctgcactgaaataagtatcaccacccagcattaatcaatgccgtgttgtaatcaataccatgttgtaatcaatgctgtttagtcaatgctgtatcgtgactcaaaacggctgccccactcgggtacagccgttttttattactcttttttatgtttgattactggccgttttgcgctttattcttcttcattttcatcactggcgggccgtttactgcttaaaccatactcccgtaatttattggcgatcgcagtatgcgaaacacctagccgtttagccagtttacgggtgctgggataattacgataaaggcgagtcagcacagaacgttcgaaccgcttactgatgtcatcaagtgaaccatcaaggacttcatcacccaacgtggcttcaatttcaaactccggcaggatgatatcctgtggccttaattcggccccctccaactgagtgagcgcacgataaatcgcatttttaagctgacgcacattacccggccaaccgtagtgagtcaggaaactggccaactctggtgacaattttggccgcggcacaccttgctcatcagagaatcgcgctacaaacaactcagtcaatggcatgatatcggtctgacgctcacgcaatggcggtaatgtgatggtcaggacattcagccgataatataagtcttcacggaattccccacgttgcaccaactccaccagatttttttgggtggcgcaaatgacacgcacatcaacatgcacttcatgttcttcgcctacacggcggaatgttccgtcattaaggaaacgcaacagtttgatttgcatacgaggtgacatttcaccaatttcatccaataggaccgaacccccatttgcctgttcgaagaagccctttttgccttcaatagcgtttgggtacgcgccagccgcataaccgaataattcactctcgaccacttcatctggcagtgaagcacaattcagaccaagaaatggcattttcccccgaggactgcgcaagtgacaggcacgagccagcagatctttaccggtccctgtatcccccaccagcaataacggcgcatcaagcatggctaattttcgggcttgagccaaaacctggcgcatcttcgtgctggccgccactatctgtctaaactcggtatcatcattgaccgataaagtttgcagttgctgccccatgcgtgcggttgatttcaacatcacaaccgcgccaacggtttgttttttctggttttcgtcttcgagattaatcggtgtaatctccatcaggtaatcctgattattgatcaatacccgttcagtatgaggggccgtatcgccgccttcaaaccagcgtgaaaaattatagccacccagcaggctgcccgccgttttatggcgaattttttcttcactgagggagaatagcgcccgggctgcggggttagacagctcaaggttcccttttaaatcaatagagaataccggttctggcatagattccagcagcgctcgcaacgaacggtgttcgcgctctgatggcataaaggaaacggtacggacatctgttaccccatcaatacgccgaatctccatcattagtgcactgaatatactgaaatccagactggaaaaattcaggtaaatgcgaccaataggatcaatttcgatcccccgtaaatcaatgctgcgtaataccaagagatcaagcaactctctggtgagaccgagccggtcttcgcaaaaaacttccaagcgcatcagtattgaccttatatatatgacaggtgcggaatcactggcgatgataataccctgtcccctcttactgatgaagcagtctgtcagcaaaagttgacaggaatcgtctttttgttattttttttcccctgattgaatcatatcaggcaatatatttaacgattaaattaactataaatagtgtgttattagacagatagttaataattcagaataatataataccagtaagtgtcagcttcgccgtcaagattgggtgacactttgcattacttcagccaattggctatagtaaatgtagccaactgaccgaggaagttacctggaggaggttacatgagagcgtaccgcccaaaccccgcgactaaaatgggaacgctttggcgtgaaattggcttacccgctagccgcggcacgatattggtcgatagtatcaaaatggggttttctgttgatgttatcgacagcattcatttatgggcatccatgcctaaagctgaaatattacgtgctaccggtatccccagccgtagcctgactcgccgccgcacacatgatggccgttttacgcctgaagaaagcgagagaatcgcacgttttgtccgcgtaatggatgccgctgtcgatttgttcggcggcgataaaggtaaagccattacctggatgtccacgcccatcaaaggattggggtatcgcagcccagactccttactggaaaccgaaactggcgcactggaagtgtgtgatttgattggtcgtttggaacacggcgtctttacttaacggcttaagccgcccgatggaacgaaacttatgatgctatccctatgacgctattatccctatgacgctattatccctatgacgctataccgcattgttatgcgccgctatcttgcatcggcatggactggttacggcgctgaaatctatggtggtcgttggaatcataaaggccatgctgccatctatttagccagcagtatttcattggctatgctcgaaacactggctcatattcaggacagttcaacactcagcgaatttgaattattccaaattgaaatcagtgacagcagtattatgttgctacagccgcaggactggcccacggattggcgtagcgatccggcaccggtggcaacgatggatgtcggcaccgagtggctggaatcagaatcctcgctaggcttactggtcccgtccacgttggtgccgtcagaaaacaacctactggtcaatcctcatcacaaagattttccagcgtgtttggccagcgtcaaaccgctctcttttgtctttgatccacggttaaaatagcctttattattaatgtgctgttttatcttttttcggtaacgtatttttcagttgattcatcaactggcggcggaaatcacccagtttaggtttatcaccctctaaccacggtaacgggcggcatagctccatggctttgatccccaagcgcgcggtcaataacccagcgccaattccttgagccgcacgcgctgacaaacgagcagccaaatcttgtgatagccaatccatgcccacctcccgtaccaactcagaggcgccggcaaaggcaatattcagcaataccagacggaacagacggatacggctgaaataccctaattcaataccatacagtgcagcgatacgattaatgagacgaatgttacgccaggcaataaaagccatatccactagcgcgagagggctgacggcgatcatcaacgctgattcagcagcatagcggctgatttctgcccgagcctgattatccagcgcgggttgaaccagtttggcgtacaattcaaccacttcacgatcattatgcgtttcatgcagtgatgcctgccagcgctgcaatgccgggtgcccttggtccagccctgcctgacgggctaatttctcacagaaaacacgcccttgaccaacaccgtggctgaccaataacgcccgagcaatatcacgctcttcagcccgttggcgtaaatgatataaacgccgccattccgtcaccaccgagccgacacccgccagaataattaacccccctgccgtagtggcgcccaaagcgatccaatcttgctgctgccaggcttgattaacccattgcactgactgggcaatcacactggcccccaagataaccatcccggcagtgaccatcttacgccacaggctacgcttaggtttcaatgcagcattcaccaacccttctacccgcccctcttcatcttctgcatccaattccggggccgctggatagaacttctccgccgcctgttcatcaaaagcctgcgccgattttaataccggttcatccaacgattgcagaggctgctcaaaatcaatccgtggctttaacggttcgctcatcgcaatttatctcccaataaaaactccatcaccgcatctaaccggatatgaggtaatgggctgtcaatatgaaccgcttgcggacggaactggtcaaaatggaaaccttgctgttgccaaaatgcagggccaggtaaacgggctggaacatcaccggggaacaccgttaatggggcaccatcttctaagcgatggccgcgcagtgccggtattttttgcccttggtgatcaaccatgccactttcggtggcctgtactgaggccaacccgacacaatccatgctgatcccttcaaaagccgcattctgccaagcttcctgcaccagttgttgtaataatgagaccaaattagcatgctggtcagcagtcacatggtctgctttggttgccgcaaacatcaacttatcaatacatggagagaataaacggcgaaataacgtgcgtttcccataatggaaactctgcattaattgtgtcaacgccaaacgcatatcgttaaacgcctgaggcccacgattaagtggctggaggcaatctaccagtacgatttgccgatcaaaacgaacaaaatgctctttataaaagcctttaacgatcgtattacagtaatagttaaaacgggtgcgcaacatgcccagatttgagtgtttatcggcctgagccaaacgcgactccccaatgccattgacatccagccaagggaagaactgtaatgcgggggcaccggccatatcgccaggcagcacaaaacgccccggttgaataaaatgcaggccttcatttttacagcggacaagataatcggtatacgcctgcgcgatagcagccagttggttttcattggccggagctaatggatcacattgctggcatagcgctagccaaggcttggcccactcagcgcgatccccttgcaacaacccttccatctggcgggaccaactcaaatagtcctgctccaacatgggtaaatccagtaaccactccccgggataatcaacaatctccagatacagcgttgatgtctctttaaaatggcgcaacagcgaatcactggagcgaaaacgtaacgccagacggatttcgctgacgccacgggtcggcgttggccaatttggtggcgtaccatacaaagaagccaagccttcatcatacgtaaaacgttgaatacccagatcacgctgtggaacccgcttaacacccagtagcctttcgtcacgcaccgcagaaaacagcggcagacgcgcaccactgtggacatgcagtaattgattcactaaagaagtgataaaggcggtttttccactgcggctcaggccggttaccgctaaacgcaaatggcgatccatcccgcggttaaccaatgatgtaagctcattttgcagtcgtttcatgcttctccttggcaaattgactcgctactgccgccattgcacgttttagcattggctccaggatgatcagcaacaaccaacgcagcggtttatagctcacacttttcattatcacgctggcagcccctgccgggccgtacatcaatgcggcagtaaacataatcttaatcagcttcgtcaatattacacctgcgcgtgtaggggcaggattattgttcatcattttgccctccggcagggattaaacagagaaaacgccagcattacctgatggcaggcccgcctaacggttgaattttctacaaaactacaactgacggaaccggcttcggacaccgaaagtatctgaggtcacatagcgttccacctgacgtagctgttgctcgccctgcgccaattcgtgttgcaattgatccagtaactggcgcggtgtgacgtcattatcgttagtcacactggctgccgataccggctccagcataaacgccagtatgatgtaggccgcaacagtgaacacgaataggccaaaaaacagtgataacaccattatcacgcgaaccaaccgtactggaatatcaaaataatgggccagaccggcacatacccctttgatcatgccctcttccggtacccggtacagttttttactgcctaacacattcgccattatgactgtctccagttagggtgttctgtatccagaatttcttctagtgcctgaatacgctcacgcatccggcgagcatcctcggttaacaatgataaacgctgcatatcttgatgacttaactgaacgccattttgctgacgaccgttgtaatgtaaccataaccaaatgggtgcaacaaaaagcacgaaaatggttaagggtatggcaagaaacagaatactcattgattccccttatttatttttgactgcgggtacatcgattatagccatggcagcgccctactgaggcactgccggttccgtatataccctttgaactcgaagctatcgcgatgctccaatgacattaagtaccttgtttgctaataaatacggaaaattaactattcaactgatttcattttcgcttttaatgccgctaattggctactgatttcatcatccgctctcaactcggcaaactgttggtccaaagacttctgtttgccaaccccaacggtttccgcttcagcttccatatggtcaatacggcgttcaaactgctcaaagcgcgccatcgcttcatcaagcttaccgctgtccaattggcggcgtacatcacgagatgacgatgcagcctgatggcgcaaggtcaatgcctgttgtctggctcgggtctcggtcagtttattttccaactccgtaatttcatgcttcatgcggctcagggtttcgtccacggttgccacttcacgttttagcgtctcaactaacgtcatgactttctgtttttcaagcagtgcagcacgcgccaagtcttctttatctttacgcaaggccagctcagctttttcctgccactcctgttgctgactttcgctgtggtcaatacggcgtagcagttgctttttctctgccagtgcacgggctgatgttgagcggatttccaccagcgtatcttccatttcctgaatcataagacgcactaatttctgtggatcttcagctttatccagtaatgtattgatgttcgcgttcacgatgtcggcaaagcgagaaaaaatacccataatttacgtcccctttgacttattggttctctgaaatagtggcgtctgattgcgccgttagcttgatgggcaagatccgttattcacgatgctgccattcaatacgcttcacatagagttaatcaagagtcgtgccaacttttcatgataattaatagcatgaaaattaaagagaaaataatttttattcaaatgatatacaatatgaagtgattattttaaccaactattggcgaatttcatcatgaatgagcaactggataatctgctcggcgaagcaaacgcgtttgttgacgtgctggagcaagtctcgggactggcaaaattgaacaaacccgtgttagtcattggggagcgtggtaccggtaaggaattgattgcccatcgcctgcactacttatcagaacgttggcaagggccatttatctcccttaactgcgccgcactcaatgagaacttactcgattcagagttattcggccatgaagccggggcctttactggcgcgcaaaaacgtcatctgggccggtttgaacgcgcggatggcggcactttatttttggatgaattagcgacagcacctatgctggttcaggaaaaattattacgcgtgattgagtacggccacttggagcgtgttggcggcagccagccattgcaggtcgatgtccgtttagtctgcgccaccaatgataatctgcccgcgttggcggctgccggaaaattccgtgccgacctgctagaccgcctcgcctttgatgtcgtgcaattgcccccactgcgtgagcggcagcaagatatcatgttactagccgagcatttcgccatcctaatgtgccgtgagctgggtcttcccctcttttctggttttactgctacggcgaaagagcaattactcgaataccgttggccggggaatgtgcgtgagctaaagaatgtggtagagcgttcggtttatcgccacagcgacagcagtctgccactcaataatattattattaatccttttgctagcaaccagaagggtgagatagagggtgtggatacgcccaacgaggggggagctgtgttgcccgcactgcccgtagatttgaaacattggctgcacaccagcgaacatcagatgctaacacgggcattaaagcaggctcggtttaatcagcgtaaggcggcgcatttattggggttaacctatcaccaactacgaggcttattaaagaaacatacaattttgagtggggagttgccccaagtcagtgattccggtgagtgagtacagctaattttcattgatacaaatagcgctgcagcatcaaggacgaagggtaaaaaaaagccagcacccgagctggcttaaaatactggaagcaatgtgagcaatgtcgtgcttttctgaccaaagccaaagccaaagccaaagactgcctgccttgttctgaatcgcatcaaaatgataatacttatcaatatcaattgtaaatagatttgttgagaattctgctcattcccatactccctaaagtgttattagcacctataaagtgttattagcacctctattgggggaaacacgcctcctgccgatgaataatcaggcggtgcctccgatggctccatatctcgcaggtaggttgctattagcttcatcatgcataagcttcatcatgtatctcctcacacgataaatttttcccacacatcacacatcacacactaaatttttccccgcacactaaacacaacgcgttaccgtttatcggccgaaattgcggcaatcccctcagatgaaacagttgttttgtgcaatggattggggggatcgtcagattacggtacactaagcgtattgcttactcactgcgaaagcgtttatgcgtggtttactgattttgctgttgtcgctgatttgccttgcaacccctgtgctggcacaacctgttgcagcggagcaaccgctaccggatatccgtcagcgcggatttgtctattgtgtcagtgggatactcaacacatttaacccccaaatggccagtagcggtttaaccgtcgatacacttgcagcacaactctatgaccgtctactggatgttgacccctatacctaccggttaatcccagaactggcggaaagttggcaagttctggataacggcgcaacctaccgttttcatttacgtaaagatgtgccatttcagactaccgactggtttacgcctacgcggatgatgaacgccgatgatgtggtcttcagttttcagcgagtatttgactcaaagcatccgtaccacaaggtcaacggcggagagtacccctactttgatagtttgcagtttgcaagcgccgtaaaaagcgtaaaaaaattggatgattacaccgttgaatttaagctaaaagccccagatgcgtcgtttctttggcatttagcaactcattacgcccccgtattgtcttcagaatacgccgatgtcctgacccagaaagggaaggaagaacagattgaccgtgagccagtcgggaccgggccttttctattggatgaatatcgttctgggcaatatatccgcttgttccgcaacagccactattggaaaggtgtgccacgtatgccacaggtggttatcgacttaggggtcggtggaacggggcgtttatcaaaactgttgaccggagagtgtgatgtgctggcctatcccgccgccagccaattatctattttacgtgatgacccacgcctacgcctgacactgcgcccagggatgaacgtcgcctatctcgccttcaatacccgcaagcccccgttaagtgatcaacgggttcgccaagcgatcgctttgtcgatcaataaccaacgattgatgcaatcaatctattacggcacagctgaaacggcagcctctattttacctagagcatcatgggcttatgataatcaggcgcaggtgaccgaatataatccggaaaaagccaaagagatcctcaaagatttggggataacccaactgcaacttaacttatgggtccctactgcatcgcaatcttataatcctagcccattgaaaactgctgaattgatccaagcggatttagcacaagtggggatttccgtcactattgttcccgtcgagggccgtttccaagaggcccgtctgatggagatgaaccacgatctgacactttccggttggtctactgacagtaatgaccccgacagtttcttccggccattattaagctgtgcagcaattcgttcgcaaacaaactatgctcactggtgtgatccggcctttgatgaattactgcaaaaggcattacgttcccaacaattatcggagcgtattgagtattatcagcaggctcagcgtattctggagcaacaattgccgttactgccactggcatcgtccctgcggcttcaggcataccgttatgacattaaaggcttggtattaagcccgttcggtaactcttctttcgccggtgtataccgcgaaagcgatgagggcaagacgccatgattattttcacattacggcgattattactgctcgtgataaccctgtttatgttgtcattagtcagctttagcctgagctattttaccccctatgcaccgttacatggggccgggttactggatgcctaccgcttctatttcagtagcttgttgcaatgggattttggcatttccagcattaatggccaaccaatcagcgagcaactgcgagaagcctttcccgcaaccatggaattatgtgtactggcctttggcctcgcgctgtttatcggtattccgctgggcattattgccggtgtaatgcggggtaaatgggcggatatcgccatcagtaccgtggcgttaatcggcttctcgatccccgtattttggctggccctgttactgatgttgttcttttctctgcatctggggtggttaccggtttctggccgttttgacttgctttatcaagtaaaaccagtgactgggctggcattggtcgatgcctggctatcgccctcaccttaccgcaacgaaatgatgctcagtgcacttcaacatatgatcctaccaatcaccgcactggccgtggcaccaacaaccgaggtcatccgcttgatgcgtaccagcaccgacgacgttatcgggcagaactacattaaagccgccgcaacccgtgggctatcccgcttcactattatccgccgccatgttttgcataatgccttgccgccaattattcccaaattggggttgcagttctccaccatgctgacactggccatgatcaccgaggtggtctttaactggccagggttaggacgctggctgattaatgcgatccgccaacaggactatgccgcaatctctgcgggggtgatggtcgtgggttcgttagtgatcgttattaatgtgctgtcggatattctgggtgccatgatgaccccgttaaagcataaggaatggtatgcccttcgataatgtctaccgcgaaaagaaaatgcccagcccattgctgtatacctggcgtcttttctcttctgatggcctggcgatggtgggtttctacggcgtcttgggtttattattgctgtgtctgttggggagcacgcttgcgccttatactctcgatcaacagtttttaggctatcagctattgccaccttcttggtcacgttatggcaatgtttccttcttcctagggaccgatgacctcggtcgtgatgtattgagccgcttactgacaggtaccgcgtctacttatggctcagcgctcctggtcaccgtagctgcggcgttgtgtgccattgttctcggtgtatttgccggtatcacccgtggtttgcggtcagcgatccttaatcatgtgctggatacactgctctcaataccttcactgctgttagccatcatcgtggtcgcctttgtcgggccaagtttggaacatgcgatgtttgccgtttggctggcgctgttaccacgaatggtgcgaactatttatagcgcagtgcatgatgagcttgataaagaatatgtgattgcagcccgtctggacggcgcatcaacaccgcatattctggcctacgccatcttgccgaatatcgcctcagtcctggtcactgagtttacccgagcgttatcaatggcgatcctggatattgccgcattaggtttccttgacctcggcgcacaattaccctctcccgaatggggagcaatgctcggtgattcgctggatttggtttatgtcgcaccatggaccgtgatgctgccaggcggcgcaattttggttagtgtactgttggttaatctgctgggtgatggtatgcgccgtgccattaatgcgggggtggaataatgccattacttgatattcgcaaccttaccatcgaatttatgacgtcagaagggccagtaaaagccgttgaccgcatcagcatgaccttaactgagggcgaagttcgtggcttagtcggtgagtctgggtccggtaaaagtttgatagccaaagctatctgcggtgtcagcaaggataactggcgcattactgctgaccgctttcgctttaacgacattgatttactccaactgactccccgtcagcggcgtaaggtgatcggccataatatttctatgatttttcaggagccgcaatcttgcctcgatccatcagaaagtattggcctgcaactgatacaagcgatccctggctggacatataaaggccgctggtggcagcgttttcattggcgtaaacggcgggcaatcgagttattgcatcgggttggtatcaaagatcacaaagacattatgcacagttacccctacgagctaaccgaaggtgagtgtcaaaaggtgatgattgctatcgcgctggcaaatcagccacggttgctgatcgccgatgaacccaccaatgcgatggaacccacgacacaagcacagatttttcgcctgttggcccggttaaatcagaataacaacaccacgattttgttgatcagtcacgatttacagatgatgagtaaatgggcaacccgggttaacgtactctattgtggtcagacggtagaaagcgccgtctgtgaagacttactgtctaccccacatcacccttatacccaagcactgattcgtgcaatgcctgattttggccgatccctgccccataaaagtcgcctgaatacgttgccgggtgctatcccatcgctggaacatttaccggtcggttgccgtcttggcccacgttgcccttacgctcagaaaacctgtattgaaacaccgcgcttgcggctggtgaaaaaccacgcctttgcctgtcatttccccttaaatctggaggagcaataatggccgagacgttgctcgaagtccgtaatctgagcaaaactttccgctatcgtaccgggctgtttcgccgtcaacatgttgaggcagtaaaatcggtgagttttaccttacgcgaaggccaaacactggcggtgattggtgaaaatggttcgggcaaatccacgttggcaaaaatgttgtcaggcatgattgagcccaccgcgggtgaattactgattgatgatcatcatctcgcttatggtgactatgcttaccgtagccaacgtattcgtatgatttttcaagacccaagcacctcactgaatcctcgccagcgcattggccagttgctggatgccccactgaaactgaatacagaactcgatgctccggcacgtgaacagcggatctaccaaacactgcgtcaggtagggttattacccgatcacgctaattactatccccacatgttagcatccggccaaaaacagcgggtggcactggcacgggctctgattctgcaacccaaagtgattatcgcggatgaagcattggccgcattagatatgtccatgcgctcacaaattattaatctaatgctggagttgcaggaaaaacacggcatatcctacatttatgtgactcaacacttggggatgatgaaacacatcagcgaccaggtaattgtgatgcatgaaggcgaagttgtagagcgtgggagtacggcggaagtcttggcagccccgctgcacgacctaactaagcgtttgatctccagccattttggtgaagcattgactgcggatgcctggcgtcgagataccagcaatttttagcgtcagcctcacctactgagagtgacggtggttaacctccccgctatcttttgatagcggttatcttcttttaacaccaagaatctttcaataaagaatcaaccactgtaatagcattttatgctgcatataatggcatgttattactttttgttatggattatggtttaacattattttatctcacaaacttaatcggcaatgatgatatccaccgtgctcatttgatcaaatgataggatatcttaccgatgatgctctcccttgcttcttgttccataacaagtctctgtccaatagctgagccacccgatgcgactggattacctgttatcaccctgcacttatccttaatacgaacaaatcgctgccctgacggaggtcatcattatggtgcaatttcgcaggagaaataatgcccattggtatcatgagactcagtgtagcggcagcctggagcattgtagcggtagcccagtgaatatttccacgacagtgaatgttcccacgacagtgaataatgaaaacccccctgttgatattcggccacgtgatcccagcgagagtgacaacatgagcactggcagtaatataactgaacagagcatcataactgaacagggcatctttctacttggcgtgacagaaaacatcgctcctacattacaagacaccctctaccatgagcagcctattcttactgcctccgacgccatgtatcaggccctgttcccaacgattatcgagatcaaccacaccaataccttctcactttatgatcggttaagtactgcgctgacggtcgctcaggttaccgggattcagcggctatgtagccactatgctctccgtctcgcgccgctccccagcccggatgcctcaagggaaagcaatattaggctaacgcaaattacgcaatatgcccgccaattggccagccaacctacgttgatcgataggcatgctttagcgcaattgcatgacgtgggtttaactgatagcgatatcattattttatcgcaaattattggatatgtgggatatcaagcccgagtggtcgctggcatctctgcactggctggttaccctaccgtgatgctccccggtttcccccgcatggaagatgccgcccccagcccattaccagatgtcatgcccaattggcaaggttggctaccgtctcatgcggcaaacgacgatcaacccgataaagaacctgacgaaacggccagcacactgactgaactgttgggccatcaccagcaaagtttgctcgcttatcacgccattaccactcaccagcccaactcacctcaattgcaacgtgactggctggaactggtggcattggtcagcgcacgaatcaatggcagcctctactgccaagcccgtcacaggcaacatttacagcaactgacggagccgcccctgttggtcactgagctgttaaaagggattgatcacgcgttattcttgttacccgaacaacaaataccccatcagctaatcagtgtaaccgccgagctcactcgcgccccggaacgctttaatcatcagcatgttaaacgtctacagacccttggcgtcagtgatactcaagtcatgcgaattattttcagtatcgccattactggttggaccaaccgcctacgacatacgttaggaaaatagcgggtcagttcgtcagggggcagccccccctcagccattattgtgcgccgtttgctatcagtaaggacaaaaatatcaggtaggtaaaaaccatcagataggtaacagtgctcaaataggtaaaaaaaatcaaataggtgaaagcgatcaattcgaggaaacaagcagatcaaagagaacaagtaaaaaatttacacaactatttttgtgggcacgcattttgcctattctgcctcgcccctgagacagattaatatttaaactattttggataattatgcataactcatcataatcacaatattgattcactcatttacatgcaagtaacgatataaaccaaaaaaatagacttcagcagaatatatacctaaacaaaatcactccccatctcaatcaaaataaaaaatcgataaatagccaaaacataaacgttaatactgcataacatttgtaacatagcgatatcgctccacgagagatatatgtaacagaatatgacaaaagccttgtctcactgacaaagatagtgaacattaaccgccgctaatcatcttataacaacacaaaagggtgtgattttcacattcacttttgtctttcctgtcagttatgaccggtagtgaaaaattagaggtcccagtgtcaacagcaaacaacaaccaaccagaaagcatcagtatgaacgctttcaaacaaccaaaagcgttttatcttattttctctatagaactttgggagcgctttggttactacggcctgcaagggatcatggctgtctacctggtaaaaatgctcgggatgagcgaagccgattcaatcaccttgttctcctcattcagcgccttggtgtatggttttgtcgccattggtggctggttaggcgataaagtccttggggcgaagcgggttattgtccttggtgcactcacgctagcggtcggttattccatgatagcctactccggccacgagattttctgggtttatctgggcatggcaaccattgccgttggtaatggcttatttaaagccaacccttcatctctactttcaacctgctacagcaaggacgatccgcgtttggacggtgcatttaccatgtactatatgtccatcaatatcggttcgttcttctctatgttggcaaccccatggctggcggctaaatatggctggagcgttgcgttttctctgagcgttgtggggatgttgattacactggtcaatttctggttctgccgtaaatgggtaaaaaaccaaggctccaaaccagactttctccctctgcaatttaaaaaattactgatggtcttagtgggtattatcgcgttgataaccctttccaactggttactccacaaccagattattgcacgctgggcgctggcactggtctccctagggattatcttcatctttaccaaagaaacgctcttcttgcagggcattgcgcgccgcagaatgattgtcgccttcttgttgatgctggaagcggtcattttctttgtgctatacagccaaatgccaacctcactgaacttcttcgctatccacaatgtggagcactcaatctttggcattggttttgaaccagaacaatttcaggcactgaatcccttctggatcatgcttgccagccctattttggcggctatctataataagatgggcgaccgtctaccaatgccgcataagtttgcctttggtatgatgctctgctccgctgccttcttggtgctgccatggggagcaagctttgctaatgaacacggtattgtgtctgttaactggcttatcttaagttatgcactgcaaagtatcggtgagttgatgatctccggcttaggtctggccatggttgctcaattagtacctcagcgtttaatgggcttcatcatggggtcatggttcctgactaccgcggccgcggctctgatcgcgggtaaagtggccgcattgactgcggtcccaagtgatgccatcactgacgcacatgcatccctggcgatttatagccacgtatttatgcaaattggtattgtgaccgccattatcgccgtactgatgatgctgactgcaccgaaactgtatcgtatgacgctggcccctagcgatcacaacgatgtcaaaatcatgacccaataagctgactaaacgcgctcctgcgggagcgcttttagtgctagttaggtgcccccgacctgcacacctgcccccctacacaacaacagattgctcaaaaaaacagactcctcagaaaatcgattatccaaagagatcggttgttcaaaaaacaaactatactaatatcagtaccgtcccataggaaacggtatttatatgatatggacaataaaatcagtccgttacctgcactgctagcgggcaaggaggtgttttatggtcaaccatgtttggggacttctgacgcatccccgtcaggaattgcaacagatcaaacgtgaaggtgagagtatcccgcatctctatactcaccatgtcctgcttcttgcggccattccggttatttgcgcgtttatcggtaccactcaagtgggctggcgctttggcaacggtcaggctatcaagctggatacacttactgcgctctactctgcggttattttctacaccctgatactggcggcagtcgcccttatggggcaggtcatttaccggttggctcgccgctatgccagccgccccagttggcaacgttgtactctgttcgcgggttatgctgcaacgccaatgttccttagcgggattgtcgccctttaccctctagtctggttatgcttatttgccgggattatcgctctttgttattccgcttatctgatgtatctggggatacccacatttctggatattgatcgacaagaaggatttattttttccagttcgacgctggccatcggggtactggtactggaactccttcttgggttgactgtgttgctatggggctatggctcgcgattaatttgaaatgtgcgctgaatgctgcgatgtgctgaataccattgtgataaatgctattgcgataaataccattgtgataaataccatgcccctgctagcggtgaatgtgctgttcgtgcagttatccatcagcattggagcctctaacaggcttttattgtcattaatatcgtttggatcgcaatatcttacatccccatacaagataaggttgtacactgagtaggactgaggcaaacaaggcgaaaaaaatgaaaaagctaacattaaaagagatgaccgaaagtgagcaacgcgacgtcaaaacgcaactagacagagccagaattaacttagggcgcgcgttaacgaactcagaacaaaataaagttaaagatgaagctatcgaaaaaatcatgcacgctcgggaacaaatcgccaagttaacccgcgtagagagaaaaacaaaaaaaacagcaccaagcactaccacttttagctggtcagcatccatcagcacgcgtccaccacggtaatcacacaatttacgttacaggctaaagttaaattacaggtttctggcagataatcactgccatcaaagcaacatcaatacaattatcaatacaactatcaatacactacagcgggggaaatcatcaccgctgtaggacttgtattgccccctcataattatataacttcactggctgtatttttcgctatcctgcattaggattaaaatggtttttcctttcagtactcttttaggaggttgtgatgaaactgttctataaaccgggtgcttgttctctgtccccccatattgtgttgcgggaagcaggactagatttcagcattgaacgtgttgatttagtgacaaaaaagactgaaacgggtgcagactatttaagcatcaaccccaaaggacaagtaccggccttagtgctggatgacggtagcctactgactgaaggggtagctattgtgcaatatttggcagataaagtcccagaccgccacttgattgccccatcagggacgctctcgcgctatcatgccattgagtggctgaattttatcgcgactgaactacataaaggttttagcccactatttaatccaaatacaccagatgagtataagacgattgtccgcgagcggctggataagcaattcagctacgttgatagcgtattagcagagcatgattatctactaggtaaaaaattcagtgtggcagatgcctacttatttaccgttagccgttgggctaatgcgttaaatcttcaaatcaaagaacgcagccatttggatcaatatatggcgcgggtcgctgaacgccctgcggtaaaagcagctttagccgccgaagatatcaagtaataaataatgagaatcaatcaattgcccccatcactagggggcaattgaaaatggttagattacagcctaaccgctgtaaactggcagataggcgtcacaatagtctcttgggcagcgacaacctgtagctcatactcccccatttcctgtgttttgagcatcacttcatacacggcggcggtgacatgttccagtgctttatccaatggctcacctttcaacaaattcaccagcaataaaccactggttaaatcaccgacaccaaccggttgacgtttgccaaaatccaccagcgggcggctgatatgccaggcatcatctgcggtaaccaataacatttcgaagcagtcagcatggtagcctgcacggctcaggtgcttgactaacacgacttttggccccctagcgcaaagagaacgggcaacctgtaccgcctgttcgacattctctactcgctcaccactgagttgctcaagttcaagcaggttcggcgcaatcatatcactggcaggcaaagcttcgttgcagaaaaattcggccacccccggtgccacaatacaccctttttcggggtgccccatgaccggatcacaaaaataccaagcatctggattggcttgtttaacctgggcgacggcggccagaatatgactgccctgttctggcgacccaatatagccactcagaaccgcatcacagtctttcagtcgatcgatatcggcaatgccttgcacaatgtcagttaaatggctagcgggcatgacacaacctgtccagtgaccatattgagtatgattcgaaaactgaacggtattcagcggccagacattcacccccatacgacgcataggaaattctgcagcgctattccctgcgtggccaaaaacgacgtgtgactgaatagaaagtatatttttcattggtacggcctaaagttaagggcgtttggtatacccttcttacataaagttgcagcggtgttagccgttttcgctcacacgaatcactgacttaaaagagtcaggtctcagcaaaaaaataagggacatttctgccccttctcttattttacgcttacagccaactaatcaggcaatagtgttttttgccacggcgcaacaaagtataacggccaaacaggcgatccgcatccgtaaagacgtattctggatcagcctgtttctcaccattgatggccacggcattagaaccaatcatcgtgcgcgcctgaccacgggaaggaaccagctcagcattaaccagcgcttgctgtaaatcagcatcacggttcagctcaaccgtcggcataccatcttgtgccaactgggcaaagtctgcttcggtcatatcatgcaaatcacccgaaaacaggctttcagtgatacgtttcgccgctgccaagccttctggaccatgcaccatacccgtgacattttccgccaaaacatattgcgcgcgcggtgctttaccactgtttttatcttcttcttccagtgcgttaatctcttccaaactcatgaaagtaaagaatttcaggaagcgatacacatcagcatcggcagtattaatccagaattggtagaatttgtaaggactggttttctttggatccagccagactgcacccccttcggttttaccgaatttagtgccatcggctttggtgatcagcggtaccgtcaggccataaacctgctgttgatggaggcgacgggtcaggtcaataccggaggtaatattcccccactggtcagaaccaccgatttgcagcgcaacaccgtgatttttgtttaaacaagcgaaatcatacgcctgcaataaattgtatgagaactcagtaaacgagataccgctgtcatcacggttcaagcgctgcttgacggcttctttattaatcatctgattaactgagaagtgtttgccaatatcacgcaggaaagtgagcacattcatgccaccaaaccaatcatagttattggctgcaatagcactgttttcaccgcaatcaaaatccaggaatggcgagacctggtggcggattttctcgacccactcattcactgtatcttcggtattcaatttacgctcactggctttgaagcttgggtcgccaatcataccggtagcgcccccgaccaacgccaccgggcggtgacccgctaactgaaaacgcttcagacataacaagggaaccagatgacccaagtgcaagctgtctgcggtaggatcgaaaccgcaatacagtgaaattggcccttgcgccagtctctctgctaacgcgtcttcatccgtaacctgggcaacgaggccccgctcttgcaattgtttaatcaggttgctgctagtcatcaatgactccattgtcttttacaaaaattggcttttacaaagtatgtgttagctaaacggaaacaccacacaagcggcgcgcatatattttcaatcggcataggcttttaatcagcataggcgtttaatcggcatatagaataaagcgcccgttacagtttaaccacaatatttcatcgtcctaaggggctaaacggtcaattttccacgcgtcggcttcccgttgatagataaaacggtcatgaaggcgatgttcccccccctgccaaaactcaacggaatcgaatttgacgcgaaacccgccccaaaaactgggcagcggtacgtcaccctgctggaatttttgtttcagctcaagaaatttgctttccaggacaccacgagcagaaatacgtgaggattgctgggaaacccaagcaccaatttgactgtctttcggacgggaatggaaatacttcaggacttccaatgtggagaggcgctccgccttgccgaggaaaatcacttgccgatccagcatatgccagggaaacaataggctgatatgcgggttctcagccaattgttgtgctttgcggctacctaaattggtgtaaaacactaagccctgatcatcataatgtttcaagagcacgatacgctggtagggctgaccattggtatcaacggtagccacacacattgcggtcggatcgggcaagcgagcttcacatgcctgttttaaccagcgctcgaataattctaaagggttttcagttaaatcactgcggcgcagaccaccccgaatatactcacgacgcaagtctgcaacatcaaactcattattctcagtcatataaactctgtaacgcgcaggaaagctgtggttatcattctgccctcgccgccacagaatcacaatcatccagagcctacgacgacgagattacttgatcaaaacacaatcattaatgatgactttctcctcgcgctcaataaatgcgctatcacccttcgaccagaaagtataatgaccatcactgtatttggcccctgatgcagcacggacttgtggtagcgttaattgtttgccatccatgatgaaactaacgttatcctgcttattgttctgagtcaccgtcagttttgtggtaccacactgataatgtagcgtttcattcaccgacgtgccattcatcgattgaagcaagctgcaccctgccaacagcaacggtactgttgctgcaaatagatatttcatcatctcgtcctgtgtgattaggtaagctaccgtaagatctaaggtagcttatcaccgtcaccatgatgatacaggatggactgctcctaaaatggtctcgcggctggcccccgtgacagaaggcaaattacccggtttaccagacaacgtgcgaaacgccagccaggcaaacgccagtgcttccatatcgtcaccacggatacccgcgtcatcggtagtacacacttccgttcccgacagtaacgctgagatgcgcgccatgactaatgggttacgagcccccccgccacacaccagcaagcgatcacatcctcccgctaaccgaacctgttccgtgatcgataccgccgttaactcagccaatgttgcctgtatatcttcagcggttacccctgggattctggccagttgcttatccagccacgcggcattgaagtattcacgaccggtacttttcggcgcaggtaaccgaaagtaaggatcgttgaacatttgctcaagcaacggctgattaacatgccctgataacgcccagcaggcatctttatcataaggtaatgagcaattgcgccagatccatgcatccatcaacatattaccggggccagtatcaaaaccccgaataggcgaatcaggtagtaggacggataaattagcaatcccaccaatattcaagaccatacgtttttccgtcgcatgcgctaataacgcatgatggaaagcgggcaccaagggggccccctgcccgccataggccatatcacgacggcggaaatcccccacagtggcaatttgggtcatcgcggcaatacgattattgtcgccgagttgcatagtaaaggcgggttcacctaatggttcatgccagacagtctgcccatggcaaccaatggcggtaatatcctgcgcagacaacccttctttggcgagtaaagccaacaccgcttctgcaaacagaatacccagttgggcatcaagttttcccactgctgacaaggtcgtggactgcccctgacacataccaaggatgtcttttttcagttgtagtggaattggatgggtatatgaggcttgctgcgccaccatacgctcatcaatagctgccagaacaacatccacaccgtccaggctggttcctgacatcactccaataaaacggcctgatttcatcacaatgaccttattctccattgaggaataaaataaccacaaaattttccgataacttaatcagaatgatacctttactgttggccgttgcagcgatgtgagcgggactcactggcgggcatcagcgcatcgatggccccttttcttcggcctgattgcaacgcttacagttttagatatataaaattaacactatgaaaagatatacttttttaagtgtatatcgccattggaacaatcttgaaagaatgctttttatttgtcgtcatggtcacataaaagtcactgttacggatgtttgtcccttgtactcccccaattcttattgttagaaagccaaaccaccgtttaatattggttaaagcacaaagcgctaagctgcgcctgtcaatcatagataacagataaagcaagcactagaattaagtaagtagtgaaataaacacctgggtaagccatactttgtgcaagtgctgagcttttgacagtgccggatttggatatcccaagcatattgaaccgtaatacggttatgcaattttaataggagtttttatgattaagccattcgtcgccgttgctatcgctgttgttactctgaccggttgcgctaacaacaacaccttatcaggtgatgtgttcaccgcatcccaggctaagcaagtacagacggtgagttacggcacattgatttctgttcgcccggtaactattcagggtggtgatgataacaacgtagtcggtgccatcggtggtgctgtattaggtggtttccttggtaatgctgttggtggtggtacaggccgtagcttggcaaccgcagcgggcgctgttgccggcggtattgcagggcaaggcgttcagggagcactgaaccgtactgatggtgtgcaactggagatccgtaaagacgacggccaaaccattctggtcgttcagaagcaaggcccaactcagttcagcgtcggtcaacgtgtcatgctcgccaatagcggcagcacaataaccgtcagcccgcgttgatagattacccggtaatcggtatatcaactcgatagctaaatcagaacagtaaaaaccggggttcattgcgaaccccggtttgttttttgtactgtggggcttgttttgttctgctgtgaataaagtctttgaactttaaattattacttagtttgtaattgaataatatttttctcaagcttatcgattaggcctgataacactgcaatttcatccgatgaaatccccccaagtatttctttgcgggtagaacaaatcacgccatcaacctgttcgattatcggtgaagactgttccgttaatttaattctcttcgcacgacgatcatttgcacaagtatgccgtgtgattaaacctttttcctccagttgatccaaggttctaaccaatgatggttgttcaataccaatcgctttcgccagttgaatctgtgattgctctggtggtaaacgattaatgttatacaaagtaacccaatgtgtttgagtcagttccaacggtttcagccgatggtcaattaatgcgcgccaaacgcgaactaatcgtgctagatcagatcctaatgtcgattccaattgctcctccttttaattagcgtgctagcataactcccagagtccagtctattttgggtaattaacattaaaaacacaaatgtatatataccgtcgatgctaggataatagcaataaatacgagcaattctttagaaaaaatgatgtatcaacgatacattacctcttaaggattaacctaatacgagtatcctcattacccagcatcgcctcgctttcagatttggttttgggtgcatcaatctattttttgccaatgtttaagaacgtttgactccgtcaggtgatacgggtattgcaccgttatctactgcgaaatcggatctcctttggcgaactcaacgtcttatgttaatagatttgtcaatttttgtcattatcgttagcacgcctttatagatataagacttgggtaaattgatatgaatcatcaatatttcaaagacttctctttcactagaaaatttgttcccctcgacatagccagatggatgtagataatatattcatgcagataatataattaacactcaatataattaatggatgtaaattaattcaaataatataattgctatagacaatatataccttaaataattcgagttgcaggaaggcggcaactgagcgacaaatcggtcgggtaaccactgttattgacacttagcgtcgggagcagagttgaacgctgctttcagcggcctcgccgaggcgagactcatggatgggcagagtaacgaacgtaaccgaagaaagtaaaactacgccagtctgagcgcgattggcgtagagaaagattaagggacatcgtagcccagcgcggcccgacgaatgcggaaccactgctggcgggtcatggtcagagaaagtgatgcccacgcggctttaacacgttcaatcttgccggaaccgataatcggtaacggtgccgaaggtaagcgcagcacccaagcgtaaaccacttgttcgatgctttcagcacccatctcgtcagcaacggtctgcaattcgtcacgtagcacttggaatgttggatcgctaaataaacgccccccacccaagcaagaccacgccatcggcttaatccgcagttgttggcaggcatccaatgtgccatccataatcgcaggctggtgcaacggtgaaatttccacctgattcgtgaccagtgagaatggcaaacgcgattgcaacaggctgaattgggtcggcgtaaaattagatacaccgaaatatttcactttgccgcttttgtgtaactggatgaaggcttctgccacttcgtcggcgtccattaaggggtctggacggtggatcaacaataaatccagatagtcggtatgcagatgagtcaacgattgctctgcgctgtgcacgatatgtgaacaatcagtgatgtaatgacccaacgcatgctctggcttcgccgtcgtcgcaatgccacatttactcaccaactccatttggtcgcgcagcgaaggtttaagacgcagtgcctgaccaaatgcttgttcacattgatagccaccataaatatcagcgtgatctacggtcgttatgcctagctcaatatgctgctccataaaaaccaacaattgctctggcgtcatgccccattccatcaggcgccaatagccacaaatcatgcgcgagaattcaggcccaagcgaagccagttggctacgtgtatccattattagctacctcatttgttaatctgccaacaagcatacacaaccagcagccaggatcaccccctgtatcaatgaattcagcgtctctcgggaagttgagcgccaaaaatcacctaaaaagcacaaaacgattaaaacagagagggttgttccggcaatggctcatccggttgtttgttcgctcgtttcaggcgcagcaaacgctggtggcataagcgtagtacttcccgtttttgcccatcatccatttttatccaattaaagcgctcatcacgactacgaaagcaaccacgacaaaagccacggtcatctgtttgacagataccgcggcaggggctgggaatatcaaaaaactcaagttgctgagccacgctgcctcctacgactaataccttaattgaagactgattcatcgcagctggcaagtcactattttcgctaatattgatgcaagcgcaatctcgccctgctaccgctaaggttatcttaagtttcattcgatattctttaggtaatgaatgaactgtaaggttaaattttcacaatgaacgctcgatataaattacagtgtaacggattaacatttattctggcctgtgcactgttttttaccttcttccaaaatgcactgtttatttataaagcctggtcgttgatccgattcgacaatagcgacagctatttttttgcagcaaccattccagtcgtgattttctgtgcactgaatattatttttagcttattaactctccctctgttacgtaagcctattattattttattcctgttgggaagtgcggtggctaactactttatgttcagctatggtgctgttatcgatgccaatatgatgcagaatgcctttgaaactaactcacaggaagccaccgcccttttcactcctcgtatggcattgtggctaataacattaggtattttgcctgccatgattgtctgctttgtgcgaattcgagcgactcgcccttggtggtatatgctggggttacgggtagcaaatattttaatgtcaatggtaataatttttcttatcgcagtcttgttctataaagattatgcgtcgctgatccgcaataataaaaatatcgtcaaaatgctgacaccatcaaattttgttagcggcagttttcaatttgccaaacacaagtattttatcagtaacatgccattggtaaaaataggtgaagacgcccataagggcccagtgattaatgcacaacaaaataaaacgctggtgattttggtggtgggtgaaaccgcccggtcagaaaacttttcattgggcggatatgctcgggaaacgaaccctcgcctgcaacaacaagatatcatttatttcaaacatgcctcatcctgtggcactgaaacggcggtctctgtcccctgtatgttctctaatatgccacgcaaaagttatgacgcctccctggcgagtcatcaggaagggttaatggatattattgcgcgcgctggattgagtgtattgtggcgtgaaaatgatggtggctgtaaaggcgcttgtgaccgtattccacaccaggatgtgacgcaattgcaactgaacgcagattgtcaggatggggtgtgtttagataatgcgcttttatataaactggataactatattaatggattacagaatgacggtgtaatcgtcttacaccaaatgggcagccacgggcccgcatactatcgccgtaccagcccggagttgactaaattcaccccgacgtgtaatagcaaccagattcaggactgcaccgcccaagaactggtcaatacatacgataactctattctctatactgatgccatgctggatgacaccattgccttgttgaaacagcacagtgaccgatttaatacggcgttggtctatctttcagaccatggtgaatcactcggtgaaaacggcctctatttacatggtacaccttatgtatttgccccaagccagcaaactcatatcccttttctgatgtggttatcaccagaatatacaaaaagctatggtattgaccgtcaatgcttatcacatagcgcacaacaggatgaagtgtctcaggataatctcttccataccctattagggatggtaaacattcagaccaacgaatacttatcaggcatggatttactgcaaaaatgccggagtctgcaatagcgatagctgtatcaacgagaagcccatcgtggccttggacaggatattttcctcaatcaaaaaattaatcagataaaacagtcaattaacaatataaaaagtcaattaacaatataaaacagtatagggctattggcaaagtgcccgtagcggagtgaatagggagaccatagccttgatgccagcgccttggttggcatttttttcttgacctagaccaatcggtctattaggctcttcgtatgaacaaaatacagcatacacatgtagacacccgagaacatctactcgccacaggtgaaaggctcagtttacgcctcggttttaatggtatggggttgagcctgctgctgactaccgcgggtatcccaaaaggctcgttttatcactattttcgttcaaaagaagtgtttggcgaggccatgctccaacgctattttgaccgttatgatgcggagatggaaagcctgttagccggttcacagggtgataaacgccatcatctattgcactattttgctcaatctattgctaactattgtgggagtgaatgccacaacgcgtgtctggcggttaaactctccgctgaggtgagtgatttatccgaacctatgcgccatgcgttggatatcggcactgctcgagtgattggccgcttgcaggatgccattgaagccggaattgacgaaggctctttgcgaacggtgctctctccggcggcaaccgcagaaacgctttacgccttgtggctaggcgcgtcgctgcgggcaaaagtgaaacactctgtcgccccactaacttgtgcactgggaagcattgaactcatattacaaccagcctaataatctaccgatcctgacactgactttttatgtttttcaggatttacccagcaactagttgactggtctattaatacaggacgaaccatgaaaactgctaaattattctccccattaaaggttggcgcgctcacgttgccaaaccgtgtctttatggccccactcacccgcttgcgtagcattgagcctggtgatatcccaacgccgttaatggccgaatattatcgccaacgggccagtgcaggcttgactatcacggaagccactcagatttcttttcaggcgaaaggctatgctggcgctccagggctacatactcaagaacagttgaacgcatggaaaaaagtgactcagggtgtacataatgagggtggccatattgccgtacaactttggcacgtaggccgtatttcccacaacagtttacaaccaggccagcaagcccctgtagcaccatcggcgattgccgcagatacccgtaccaccgtgcgcgatgaaacaggtgcttgggtacgtgtcccttgctctaccccacgggcgctggagacagaagagattccgggcatcattaatgatttccgtcaggcaaccgccaatgcccgcgaagcaggatttgactacattgaactgcacgcagcccatggttatctgttgcatcaattcatgtccccagcttccaatcagcgtactgaccaatatggcggcagtattgaaaaccgtacccgtctgacgttggaagtggtcgatgccaccgccgctgaatggggggctgaccgaattggtattcgtatttcgccattaggcccatttaatggcctcgataatggtgaagaccaagaagaagccgcactgtatctgattgatcagttgaataaacgtaacattgcttatttgcatatttccgagccagactgggcaggcggtaagccttattctgatacgttccgtgctgctgtccgtgctcattttaacggcgttattgttggtgctggtgcttacagcgcagagaaagctgaatgcttgattcaaaaagggttcattgatgcggtggcttttggtcgcagttatatttctaacccagatctggtgacgcgcctgcaacaacacgcgccactgaatgagcctgatagcaatactttctatggcggcggtgcgaagggctacaccgattacccaacgttgtgatttgtctgtaatttaaatattcaataaccgccagttaggctagtcgtctaactggctcagacgactaacaaaccccgatgacgcgatcatgaacggtgagtgtaggcagaagagtaaagcgtccatgctacgaatggtgcggacacgttgtcaataacctcactgtctcaccggatggtatgttttaggtgtacattaataatacaggcggccgttacgattaatgcatgattcgtcgtttatcaagaacgtcagcatgccgcggagttgcaactataccagggcctcttgcaataaaattctgttgccagtgttctggtagcggagtattactcgatttgtaaaagttaaacagctctttactgtcgtcaaaaacagtccattgcccctgatgtaccattgctatcgggaatggacctggacgcgcaactacccccagatagccattatcgctaacaactttatcgtgttcatattcccacatgtaaggaacaaagtttacctgaggcccatggcgaatgacattcatcgctgtatactcaaaaggccgggcgggatcgacttctgcaacgcctttattaattaggtcttttactcctgtttcctcagcgctttccgcggtgggcacatacccttttccacgattgaatttaataatatcgtgcatgtcataatccccagtataaggcgtgattatcttatgttttatccatgcattcactaattcattatcagaagtatcctgcaggctggcaggataaaccaaatcctccccgcttggtctgttgtacgcataaaccccctgcacaccagacgcattccaccggccaacccggccaataaaaccactattttttgccagttcaagagcagctccggccttattctcatagacagccttcagggatccgggtttaattgttttctcaagaatattatggccttttgctgctgcaccttcacccagtgctaaaatagtataaatacccgcttcccttacgctcattgccatattctcttcaatggatatgcgttcaaacaccgacatatgtaaaggatgcacaaaggcttcccccactaatttccttgcactctgtccttcacgtatcaagccattactgtcatggaaggatgttgggttatttcctaccatcaaatacaggttcagtccgtccactgttcccaccggatctgcggagagccagcgccccacccaaggttggtaataacgccagccatagtagtacaaccccgtcgcatcgcgttccttccctgagtatctgatcgttttgtagtctgcttccgtctggctgtgcgctgtccacaccgccgtgccgccgtacgggtagtattcctccatgcagataacattgccatccccatccacctcaagcgtactgctgccgatcaagttgtcatagctgtagcgcagttggtcattatcgatagcgtccggcttgcccttttcccaatgcagcacctgcacctgcgcccggcccgcctcaccgacagtgataatctgcaggctttccgtttctgtcacgccgctggctgtgctacgcagttccagcctcggcaggtacataacccgctgcgtctgcgtgctgcctcccgttttctgcacgctgaccttcaggatgcgctggctgtttccgtcataacggtagctttccctgtcatcgctgtctccgtcccgtaccaccgacgtcaccttcagcagctcgttacgcgctgtccagataagatgctgtcctggctgtagctgtttctgctggccgcctgccgtgaacagagcgtcaacctctgccggatttgtggtcagtgtgctcagcacgccctggttgctgcggtcgctgaccgtgatatccgttgtgtgaccactgccggttgccggggtgtgtcggatctgcgtcaggttacccgcggtatcgtaggtataggtgtgggtgtagtttgtatatgcggaactctctataggaagggtggcggaaggcaggctgcggccctgctgtccggcgttcaccatcacgcgcccggtggcgctgaccaactggtacaagctgtcgtagacatacgtattctccggcaccactttctggttgcgccagaagcgggtttcttctgcgtcgtttctgatgctctgcacgttgcccacgggatcatactcatagcgcaagtcctgaagcaccttcgttccggatgcatgtccggctgaccgctccgtccggatgccggtcaggcgttgcgtctccggctcgtatgtgtacgtggtcaccacgccgttaccgtgctcctcgcgcagcttctgcccggctgccgagtacgtcaacgattgaacgataacctgctccgcgccacctttcaccctcagccaactgcccgacagcaggcctgccacgttgtacaccacccgctgcacgttgccttttgtatcggtggtggttagcaccgcgccgatagcgtccgcagtcgtcagagtggttagcctgtctgctgccaactggtcattccaggcggagctgtcctcaccctgccagtttgccacggtatccgggttgtccgcatccttcagcaagcggcgggtgacggagagtggcacaccggtcagggcaatactgtccatctgcctcagacctgctgtgtcgtagtggctgacgcactgtccgaccaggttcagggcttttttctcgtccgtgttggcggcatacgtaaaacgctcggtgacgcgggcggcttcaccagtgacctgctctgtaatgctcagcaggcgtcccggcagtgaggcaccctcatactgccaggtacggttcaccgcctggcttctgtcctccagatcgtcgtcagcggtgtcaatattactgactgtcataaatagccgaccggcggcatcgttcagagctacagtggtaccaacatcggcgctgacggtacacagggcgtttccgaccaggtccgacaggtacttgacgttcgcccgaccagtgtcgtgcaggcggggatcggcgctttgcgtgaggaaaccacgggcatcatactggtgatgggtgatacgctcaccagtgtcatccggcgagtcgggatggcgatggtacgcgatgctgcgcacggacagcccacggttgtcgaggaccgtgaccgccggggttttactgaatagtgatgtgttcatgggattctcctgtttatgttacacagccagtgaatctgtacaaaattcatacaatcctcgggataattataggacctaatgcggagagtggggctaccgatatgacgagcttcatttgtcgttattgtgagcctgggaggaaacccaaaatgtaaagtgacctattcattctctgtaacccattgaactaatttaattaccggggctatacttgaacctaattttattcactcttgccagagcgtcgggcaaaatgtaaacagagggaaattatgcgcttactccataccatgctccgcgtcggtgacctgcaacgttctatcgatttctacaccaaggtattagggatgcgtttactgcgtaccagcgaaaatactgaatataaatactcgttggcattcgtaggctatagcgatgaaagtaaaggttcggtgattgaactgacgtataactggggcgttgaccagtacgatatgggcaccgcattcggccatctggctctgggtgttgatgatgtcgccgcaacgtgtgatcaaattcgccaggcaggcggtaaagtcacccgcgaagctggcccggtaaaaggcggtaataccattattgcttttgttgaagatccagatggctacaaaattgagttaattgagaataagagcgcgggtgacggcctcggaaactgattaacttaagggcacctcggacggtgccttttacttatcacaattaaccccctgcatccctcgcgaaaatttgacataatgcacgctgaattcgataaagataagaaactgatggcagacaaaagtgaccttaacgccctgagtggccgttttcgtgggtattacccagtagtaattgatgtagaaaccgcaggttttaatgcccaaagtgatgcattactcgagattgccgcagtaaccttgcagatgaataaagagggctggctgctacctgatgaaacgttgcacttccatgtggaacctttcgaaggtgccaacctgcagccagaggcgctggcctttaatgggatcgatccaacaaatcctctacgcggtgccgtcagcgaacatgatgccttgcatgccatttttaaagccgtgcgtaagggaatcaaagataaaggctgtaaccgggccataatcgtggcacacaatgccaattttgatcacagctttgttatggctgccgctgaacgtgccagcttgaagcggaacccgttccacccgtttgccactttcgataccgccgctctcagtgggttggtattggggcaaaccgtgctggcaaaagcttgcctggccgcaggtatcccgtttgacagtagtcaggcgcactctgcattgtacgacaccctgcaaacggcgaaactattctgtgagttggttaatcgctggaaaaaactgggtggctggccgttgccaacggcagaatcggagtaacacagcccttgtaattaaaaaaggtggccattacgccacctgaggttattgacaaagtgcccgcgacggagagaacaggcagatcgtaaagacgccgtaaatacatccatgtaggctcgagccgcgccatccttggcgcggacgctttactcctttgcctatcctcaccgttcaagatcgcgtcatcggggtttgtcagcagtctgaggtggccattacgccaccttcttatttatcacatttcggtttgtcatatcgatcaaccattcatactgacttagctcatcgtattggccgactgacacaaattactctgcggcaggctgatcttcttgtgagcgatatttatcagccgtttctttcaataacgtttgtagttcgccacgctgatacatttccatcaaaatatcgcaaccgccaaccaattcaccgtcaacccacagttgtggaaacgtcggccagttcgcatattttggcaactcagcgcggatatctgggttttgcaaaatatcaacataggcaaagcgctcaccacaagcagacagtgcctgtacagcctgagcagagaaaccgcagtttggcaacttaggtgaacccttcatataaagcaggatcgggttttctgttatctggcgctgaattttatcaatcgtcgtcatttcttgcttcctcaagccatattatggctacaacgtgtattgccttttgctcaaagcaatcgcattttatttatcgtatccggcctattgtagcgactgtcacgacaggaataaaacgccatcttttgcatggactttactcgtcgagataatggatatcgcgtcagctacaaatatgtaccttaataataacatttttgatcccatcccctcactattatcttctctctggggctgcgtccatgctcgtcgattaacccgttgacggatggtcgattcaagttcactctcagagtgaaaaaacaacaatggcaacgccattaatgttttctcacaatatcgactaaaatcctatagctctctgctttgttatatcgtgagtttcggcaatactgtcactcttcatattcgtttcagggccaaggtgggtagcgttattatgcgtttaatgcttacgctgtttgtgctgctgtttacccagctatttttaaatttggcgcatgcgtcaccgcaagctcattcgtctgttgaacagaaaaaggggcatgttagccaggccagtcctgatgatcgtaaaaagcgcaaagcagataaaagtacaaagagaagtaaaatcgctaccacgaaaggccctgtcagtaagaagacaactgagcctcgtaaaacaggcaacaataagacaagtaccaacaaagtcgttcgcaataaaataaacagcagtcggacaactgaaagtaaaactgcagctaataagaaaaggacatcaagcataagaacagccaaaacaccgtatgggcggcagcgaaataaagcgcaaggtaaggccagtaccgagttggcagcaaacaacaaacttaagctcagcccagcacacaagaagcgttaccaaaaagcgaaacagaccgcgatgagcaaactgatgaagcaagttggtaagccttaccgctggggtggcagttcccctaacaccggtttcgattgcagcgggcttatttattacgcttacaaagatgtcgtcaaaataaaaatgccacgaaccgctaatgaaatgtatcacttacgtgatgccgctcccgttaagcgcacggaattggaaagtggtgatttagtcttcttcaagatcgccaatcgcggtgtcgcagaccatgttggtgtctatttaggtaatggtaaatttattcagtctcctcgtaccggtgaggaaattcgtatcagtatgttgaataatgattactggcaagatcactatgtcggcgcacgccgcgtcgtcacacctaaaactattcgttagtaaaaactatttgttattaaaagctttgttatcaaaaatatttgttagtaaaaatattcgcgagtaaaagcatctgccagtaaaaccctctagccctaactgacggtccggtttaacggctgggtactcttgttcaataatacatcaatggcatcaaggcagtagcaccctccccctcgatcaataccccatttaactgtatggttatatctgttacccctggtagaaattgctaagattagtacttacaacaaaaatataaaaataccgtttttaaccgctcttcaccccacacctctcaacaatggtggataggatttgaagagcaaacaccctgagcaaccccgaaaggagagagctatgtcttttgaattacctgcattaccttacgcgcaaaatgcgctggaaccccacatctctgccgaaacgctggaataccattatggtaagcaccacaacacctatgtgaacaacctcaataatctgattaaagatactgagtttgcaggcaaatcactggaagagatcgtgaaaaccgccaatggcggtgtgtttaataatgcggcccaagtttggaaccataccttctactggcattgcctgtcgccaaatggaggcggtgaacctactggaaaaatcgccgaggccattaataagtcttttggctcatttgctgaatttaaagcgcaatttactgatgctgccgtgaaaaacttcggcgctggttggacgtggctcgttaaaaaagcggatgggacattggcgattgtcagtacctctaacgcaggaacaccgctgacaacaacagataaacccctgttgaccgtcgatgtgtgggaacatgcttactatattgattaccgtaatgcgcgaccaaaatatctggagaatttctgggcattagttaactggtctttcgctgagaaaaacctagactgagagtcgtgaagagtaagcagtaaccgtatacaagctacatcgataagataaataagggcggtttaaccgcccttattattaccgttcactggcaacggttgacttaattcatcaccgccacgaagctaaatataatgatcatcgccagcgcaccaacggtcgtaatcaacgacattttcaaattggtatccataaaagctccttagccggttaatttttagtaggaaaaaggcacataattagtgtgtggaatgattttcccacagataagaaaaaaaatcttgtgctcattacgcactttataactttgattacccctttcacttttcctccaaatcagccaaaattcgcagttcatcactgcgtaccgactaataacatccaataaatactctcggacaacccgctgacacgactatccaaccgactatcttgtttctgtctgagtggtttgcgggtaacgcaggcaaacgattaacatgatactgacctgtttcaaccggtcagtttaggagtcattctttttatggcaacgattaaagatgtggccaaacacgcaggtgtgtccacaaccaccgtttcgcacgttatcaacaagactcgtttcgtcgccgaaaatacgaaggctgccgtgtgggccgccattaaagagctgcattattcacccagtgctgtcgcccgcagtttgaaagtgaatcacaccaagtcgattggtttgctggcaacgtccagtgaagcgccctattttgctgaggtgatcgaagcggtagaaaatagctgctatagcaaaggttacacgctgattttatgtaattctcataataatctggataaacaaaaagcctatctggcaatgttggcacaaaagcgtgtcgatggtttattggtgatgtgctccgaatatccagatcaactgctggggatgctagaggattatcgcaatattcctatggttgttatggactgggggactgcccgtggcgattttactgactctatcattgataacgccttcgaaggaggctatttagcgggccgttatctgattgaacgcgggcatcgtgatattggtgcgatacccggccagttggcgcgtaataccggcggtggccgtcatcaaggcttccttaaagccttggaagaagccaatatccctgttcgtgaagagtggattgttcagggcgattttgagccagaatccggttataaagctatgcatcaaattctgacacaaaaacatcgcccaacggcggtgttctgtggcggcgatatcatggcgatgggcgcaatctgtgccgccgacgaactgggcctacgggtaccacaagatatttcggtgatcgggtatgataatgtgcgtaacgcgcgctacttctcaccggcactgaccactatccatcaacctaaagagagattaggcgaaaccgcctttgccatgttgctggaccgcattgtcagtaagcgtgaagatccgcagaccatagaggtacatcctaaactggtggagcgtcgttccgttgctgatggccctttccgtgattatcgccgttgatgtttgccttggccggtcgtattcagcactgccggcccgattcggataaccgcattccctgcggttatttgctatcgatggttggctatcaattgtttgctatcaattgctggctatcatcccttaaccactcagtatttagcgtgacactgtcacctagataatcaagtaaccaagccagtgcgggagagtgattattctgctcccatgtcagacagcacgggctatcgggtaacggctctgccaacgtgatcgccgctaattttccctgtgcaatcaagggcgataccatatgggcgggcaccatgcccatacacagtcccgcacacaaacaatcgattcctgttgaccaatccggtgcaaccaatcgttgctggttatctagcgtccatgtatcccgcttgggtaaattgagtgccgtgtcttccagacaaagtgagggataaggccgcaattgttcatcgcttaacggccctgatagtaacgctaatgggtgatcgacactcacaacgcatagccagctaagaaagcccatatcacgaaagacaaaacgcccacccactgggatggcacgggtcgcccctatggcaatatccgcacggccatcgctcagtgcatcccaaaccccattaaaaacctcataacgcacacgtaattcaacatcaggaaaatgacggtaaaaatctaacactaaacggcggctgcgctgaggtttgacgattttatctaccacaatgtttaactgcccgcgccagccattcgcaacttgctggcactgacgacgcgtgtcattcatttttttgataacatcgcgggcttctttaagaaaaacgacacccgcctccgtcagttccacatcacgatgacgtcgttcaaacagaggaaccgcaagccagtcttctaattgccgaacggtataactcaccgctgaaggcacacggtgcaattcttgtgctgccgcactaaagccgccagtgcgtgcgaccgcatcgaccacatccagagaatattctgaccacattactgcctaccttttagcctgctcatcttgccatcaaaatttttaacagcaccttgcaaatattaccgtttcacaacagaagatgccattggatagaatgcgccccgcaacgatttccctacgatcatttttgatagctaaaactgctgataataaccaattttaacagtaacctttgcaacaataacctttgcaacaataatcagtaacgacaataaccgtattctgtagcacccttttactacacaaataatttacctgcacaattatgataaaagagaaataaagaatgaaaacgtcatccagtttcatgttctatctggccggcctgagtatgctgggttatttggccacagacatgtatctccccgccttcggtgcaatgcaacgcgaactgcaaaccaccgccggtgccatcagcgccagtttaagtatttttctggccggttttgccatagcacagcttatctgggggcccctttcagacaaattgggccgcaagcctgtcctgttagcgggtttggggttatttgccatcggttgcttagggatgttatgggttgaaaatgccactcaattgttggttctacgcttcatacaagccgtgggcgtctgttcagcggcggtgagctggcaggctttagtggtagaccgctatcgcgacgggaaggccaaccgcgtgtttgccactataatgccgctggttgccttatcacccgcattagcgccgttattaggtgcctggttactgaaccacttcagttggcggtcaatttttgtagttctattagccattacactgctcttactgatcccgacaatggtgctgcaagaaaggaaaaaagcacgcgccgataacagcgatcaacctaaaaacacggtgagtttctggcaactgctccaatcacccacattcagtggcaacgtcatgatctttgctgcctgtagtgctggcttctttgcttggctaacgggttcacctttcattctggaaaatatggggtacagcccaaatgttattggcttgagttatgtcccacagacgctggcttttctgcttggtggatttggttgccgcagtgcacttgcccacataaaagggaacaccctgctaccctggctgttagtgggctatgctggcagcatgattgccctgtacttgatcgccaccttaacaacgccatcattgctcacgttgcttatccctttctgcttaatggcgcttgtgaatggtgcctgctaccctattatcgtagcgaatgcattaatgccgtttccagacaataccggcaaagcggcggccttgcagaataccctgcaactcggtttgtgctttgtggccagtatgttggtatcggcctatatcagccagccgctcttggcgacagtgacagtgatgctattgacggtagttttggcggctttgggttacggcatccattgttacgcgttacgtaaagacaaaaccagattgatgactcggacaccataaccaaaatgagtcgagtggttggaaagcagccagtagatatgcagcttggtgtatgacgggtatatagcccaacacataattcccttgggaaatagtcactaagatacacactggccgggaacaatttattattgagaaagcgcccaggccagcctatactcattttaaccagctataatatcacttaaaaaaatattatttgaggtttcttctgtgcgcgtggattgtgtcacatttacgcttaaggatgagtcaccctaaactaaagcgtaattagggtttcttcttaatcttcctctattacccaaaatcataagtgttgcaggtaggtagcgaatttactcacccgcaacgtcaaatatgtagggtatatccataacggatatcagacaccagggtaacaaaaccttattggtatgcatctgcgtagctaacactgaaccgcggatcataagtcagaagaaagtgatggagaagctatgagttcatcctgtatagaagatcagagtgttcaagaaagcccatggttccgcattgtgcaagacatgctgaaccaagctgatattgaaatcaatggttcacgccctttcgatattcgggtcaacaacccagacttttttaaacgggtgctacaaggaggatctttggcattaggtgagagttatatggatggctggtgggagtgcgatcgtctggatatattcttccagcgcgttcttcaggcgggtctggaacataaactcccacgccatttcaaagatactttgcgtatcgctgccgcccgtgtcatcaatttacaatcaaagagaagagcctggattgttggcaaagagcattatgacttaggtaatgatctctttactcaaatacttgacccgaatatgcaatattcttgcgcctactggaaagaagccaccagccttgaacaggcgcaggaacataaactgcaaatgatttgcgagaaattgcaattagcgccaggcatgaagctgttggatatcggttgtggctggggggggcttgctgcttatgccgccagacatttcggggtgtcagtctcgggtgtgactatttctgttgaacaacaaaaactagcacaacagcggtgtgaaggccttgatgtcagcattttattgcaggattaccgtgacttgaatgagcaatttgaccgcattgtttctgtcggcatgttcgaacatgtggggcccaagaactactccacttattttaaggtggtaaaccgtaatttaaaaccggatggattgttcttgctgcacaccatcggcgctaaccgcaccaatatgaacgtcgacccctggatcaataaatatatcttccccaatggttgtctgccgtcagtgcaacatattgctcaggctagtgaaccgtattttgtcatggaagactggcataattttggcgcggattatgaccgaacattgatggcatggtatgagcgtttccaggcagcgtggccaaatctgtctgcgaattactcacaacggtttgaacggatgtttagctattatcttaatgcctgcgcgggcgcatttcgcgccagagacattcagttgtggcaagtactattcagtccaaatggtgtgaatggggggattcgcgtccctcgctaacctcagataggagacagggggataaaaacccctgtcttattttttgtaggttatgacacccgtacgactttttcgtccactaacgccgcgttagctatattgcgctgcgccaatacccgttcaacagtatcaaccaccgcttgggtctgcggatctatctcgatattaacccggtgccctaaccgctttttacccagtgtggttcgagacaacgtttctggaatgagatgaacacagaaacgattacccaccacctcgccgattgtcaggctgatgccatcaataccaataaaacctttatgtaacacatatttcattagatcttcgctgggcatacgaaaccaaatctgacggttattttctgatgtgtatattttagcaatctctgcagtacagataatatgaccggacataagatgaccaccaatttcatcgctgaatttagccgccctctctagattaaccttatcaccaacgtttatatcccctaagttagtgaggcgtaatgtttccttcatcaaatcaaaactgacacgattgccctcaatatgtgtcacggtgaggcagcatccattgtgagcaactgacgcccccaatgccaactcaggcagcatatcaataggcagctctacaacatgcgtgcggaaattagatttttcttcgatggccaccacaagcccggtgccttgaacaataccggtaaacatacgccatgcctcttataagttatctgtagaaagaaatattatctgtgtcaattttgcctcataaaatcaggaaaaccaaaccacttagagtaaaaaagactattcagggtatttggttgatatttaatgacaaggattgcttaacctcggtgagcaggtacaatattttattgctttcccactattttatttatcatcgcctgatgataaaccgtcatgatttaaaacataattaaaaaggtgcatacgtgcagaagtatatagttgaagcgcgtagcttgttggctctcgctattcccgttgtcatcgcgcaactgtctcaaaccgctatgggtgttgttgacacgatcatggccggctctgtcagtgcaacagacatggcagcggtggcggtaggcacgtctatctggctacccgctattttattcggacacggcttgttactcgcactaacgccgactgtcgcccaacttaatggttcagggcgccgtagccagattgcccaccaagtcaggcaagggttttggctggcactctgtgtttccgtgttaattatgctggtgctctataatagtgaccacgttattaaacaaatggataatattgaccccgtgctggcgcagaaagccgtgggttttctgcatgctatcatgtggggtgtgcccggttatctgttcttccaagttctgagaaatcagtgtgaagggctatccaagactaaaccgggaatggttatcgggtttgttggcctgctggttaacatcccgattaactacatttttatctatgggaaatttggcgcgccggccttaggtggcgtaggctgcggggtggcaacagcctctgtttattgggtgatgttcctgatgatgagatggtacgtaacgcgcgcccgttctcaacaggatatcaaactggaaaaaggatttgccgcgcccgattggcaggtaatgaagcgtttaagtggccttggcttgcccgtcgccttggccctttttttcgaggtcacgctgttcgccgtcgtcgccctattggtatcgccactgggtattgttgctgttgccggacaccagattgccctcaacttcagttcattgatgtttatgttacccatgtcactgagtgtagcagcgacaattcgtgtcgggtttcgtctcggacaaggggcggtggaacaggctcaggttgcagcctataccagcatggcggttggtttattgctggccagcgttaccgctgtgtttaccattgttttccgtgaacatattgcgttgttgtataacaagacacctgaagtggttaccatggcgtcccatctgatgttgctggcggcactttatcagttgtctgatgccgttcaggttattgggagtggtgtcttgcggggctataaagatacgcgctccattttctttattacgtttaccgcgtattggcttctcgggttacccagcggctaccttctgggcttgaccgattatatcctccctgcgatggggcctgctggtttctggataggtttcattatcggtctgacggctgcggctattctgatggtgctgcgtatccgttggctacaaaaacaacctactgcgtttattctgcaacgggcagcccattagcttatcgtggagtggggctaccccccgctccgccataaaacacctgtaggggcttcgcgcggttagtctcaaataaaagggagtctccccaacaacatctggatgaaaaaacagcgtaatggataaaagcacagcgattacgtgagtttacaataaatattgcgtttttcctcttgccagcagacgggcagcccgttagtattcgtccccgctgtcaccgttgatagtaggcaataatagatgcgtccgtagctcagttggttagagcaccaccttgacatggtgggggtcgatggttcgagtccattcggacgcaccactttttattgcacggtagtcagtctaatgtgatagctgttttaccagaaagaattatgtgcgtccgtagctcagttggttagagcaccaccttgacatggtgggggtcgatggttcgagtccattcggacgcaccattctgctattattgtaccattctggtattattgtaccattctggtattgttgtaccattctactattgttgttgggctgtgtttttatccgacacgtctttcaagcagcatgtttttttactcggattttttatccggattggtttttacccaatgtcgttgtcaccctgcgttcttagctcagttggttagagcaccaccttgacatggtgggggtcgatggttcgagtccattagaacgcaccatttcttttctctctcctgtagtcctcctctatttttcctttgtcagttcctgactattggttgatttcttactgattcgagtcgtctattgataatgttcacctgccgcagtggcgcgccataagtgagctggaatgtttaagtgccccctatttactgtcaaaaaaatcaacaaacaaacaacttgcgcaacaaattaagatttaatctctgcgtttgcgtcattaatccctactttttacaaaaaacggcaatgagctcctgttttctatttcatttcccgtcacttaccgcttataatacggaccgtcgtttcagttgaatggtttcagcattttgattatccgatacgctaaaaaaatacaactctcatttatgccatcgtgctctgatcatgcgctgagtctcgcgctaaaattttccgctcaacttccaccactgtcatctatccttagtaatgttttatttcttggtcacgtttcgctacacccaacaccaatcagataccactccgttgttgtaaataacggaactttcactttttatccatcacaacttgtagaaaaaatccgtcatgaaaaagactaaaattgtttgtactatcggtccaaaaaccgaatccgaagaaatgctgacaaacctgctgaatgctggcatgaacgttatgcgtttaaacttctctcacggtgactatgcagagcacggtcaacgtatcaaaaacctccgggctgtaatggcaaaaacaggcaaaaaagccgcgattttgctggatactaaaggccctgaaatccggaccatgaaactggaaggcggcaaagatgctgcgctggttgcaggtcagaccttcacgttcacgactgatcaaagcgttgtcggtaacgacaaaattgttgcagtcacctacccaggcttcgccgctgacctgaaaattggtaacactgttctggttgacgatggcttgatcggtatggaagtcattgaagtcactgaacacaccgttgtctgtaaagtcttgaacagtggtgatttgggtgaaaacaaaggcgttaacctgccaggcgtgtcgatccaactgcccgcattagcagaaaaagataaaggcgacctgatcttcggttgcgaacaaggcgttgatttcgttgccgcctcctttatccgtaaacgttctgatgtactggaaattcgtgaacacctgaaagcacacggtggcgaacatatccagatcatctctaaaatcgaaaatcaggaaggtctgaataacttcgacgaaatcctggaagcctctgacggtatcatggttgcccgtggtgacttaggtgttgagatccctgtcgaagaagtcatcttcgcgcagaagatgatgatcgagaaatgtaaccgcgcacgtaaagttgttattactgcaactcaaatgctcgattccatgatcaaaaacccacgtcctacccgcgcagaagccggtgacgttgcaaacgccatccttgacggtaccgacgcggtcatgctgtccggcgaaagtgctaagggtaagtacccattagagtctgtcaccatcatggcgaccatctgtgagcgtacagaccgtgttatgcctagccgcattgagtcactgaacgacaaccgtaaaatgcgaatcactgaagccgtttgccgtggtgctgttgaaaccgcagaaaaactggaagccaaagtgattgtggtcgcaaccggggggggtaaatctgcaaaatctgtccgtaaatacttccctactgcgaccattctggcactgacgaccaatgaaatgacagcccatcagttaattctgactaaaggcgtaatcactcagttggtagacgaaatcgcctcaaccgatgatttctaccgtctcggtaaagaagcggctctggcgagcggcctggcacagaaaggcgacgtggtcatcatggtttcaggtgccttggtaccaagcggtacgaccaatacctcttcagtacacgtgttataattccaacgcgttattgttcaataattaaaacgccgctctctatagcggcgttttcttttttaaagcttgcctaataaactttctgaaaaaattttactttatcctaatcccgctatagcgcaccttacaaataagactagtcccatagaacccggctgttttgtctcgtttttttaacttttttttaaagcaagatgattctttgagctaacgagcaaaataaaccctcttaatactaaaattttattctctttcgaaaaaactttgtgtaatacttgtaaggctacatggagattaacttaatctagagggtgttaataatgaatcgtactaaacttgtactgggcgcggtaattctggcttctacaatgctggctggttgttcaagcaatgctaaaatcgatcaactgtcttctgacgttcagactctgaacgctaaagttgatcaactgagcaacgacgtgaacgcagtgcgcgctgacgttcaagcagctaaagacgatgcagcacgtgctaaccaacgtcttgacaaccaagctcaagcttacaagaagtaatattacttcctgaatgaaaaatggcgcacattgtgcgccatttttttgccctacggaaatgtttgtcgtacagaaatgaacgtctgacaatcgctctccttgatgtcactccctcttccatactcatgctgaccacgactactcaataatgaccaactgcgactcaacactgacaaacacccccaggttgacctggtaccgcatgcttgcttatattttgatgaacacgtctatttcgatgataacttctcgcactggctttaatattctgactttcacaacgacaagcctctaaagcgcggaatacaattctggctttaccacgatggatctccaccacggtaaagcacagacaagtgattagttattttctgaataaaccgggccgggctgaaccagcttaggcatcactgactcttctgtcggttgtagtgcttcagcctgtgcctgttgctcatcctgagacgctacaggcgttggcgcttgctgagtagaagcttcacccacagtaacgatggttggcataccagaacggcgtacaatcgcatcctgaaccgctttagcatccgtctggctatcgttgatgaacttctgcaagccactgccgatcgcgattggcatcgtttgtggatcatcactgtctacacgggacaacggctgatgaacttcaacgtaacgtttaccatcaggttcaacggcatatttaacgggttcgttaatgatttgtacgcgagtgcctttaggaactgagttgaacagtgcttcaatgtcatctggacgtaaacgaatacagccagagctgacacgtagaccgataccgaagtcggcgttagtaccatggataaggtactccccccttcctgcggacagacgcagagcaaactgccccatagggttgtcaggaccggccggaaccactgatggcaaggtgataccttctgccaaatagtttttacggatgttcgcggttggcgtccaagttgggttagggatcttctggctgatagaggtaaccatagtgggtgtatcacgccctaactgaccaatgccgatgggataaacaatcactttgttctgacctttagggtaataataaaggcgcagttcagccaggttgatgacgataccttcccgtggggtgtcaggcagcaacatctggttcggaatagtcagtactgaccccggtaatggcaaatagggatcagtccctgggtttgcttccagcatacccaacaggccaatcttgtagtcggctgcaatggcctccaaagggcgaccatcatttggaacagtaaaggttgtattttcgccaattaagcgactattagcgggcggcagtgggtactcgttcgcattggcagcagtaagactacctgccagacaagttgcaaataacataccaatcaaagttaatgcacgtttcatgcttagttcctacatcacttcttcaaattcggtttacacggctatctacgttaattttagcagccaataataaggcaaatgtatagtaacagcccttattataaaggcaatttatttctctaaaaatcaatgtgttacaaagtaatgtattgtagtttttttagcataagcgccgatttaagctgctgaaatctcaccattttaatactgtgactcacaacgcaaaaatgggcagagcccaataattaaagagcaaaatattagcctgtatcaatgcgctgataaattggcaactttagtgcgaatggcgcggatcatcgcctccagaccttgtgagcgtgaaggtgtcaaatgctggctaagcgctaaatcagcaaagaatggacgcacatccagagagattatctgttgaggtgttaaatcgtgataaaggatgaataccacggcgaccagacctttaacgatagcagcatcgctatcgccggcaaatatcacatggccttcagcagacaatgtcatcgcgatccagacctgactctggcaaccggagatcagattctctgggtggcgctgttgttcggtcaacggggctaactgcccgccgagttcaatgatgtacaggtatttttcttcccaatttaaacagcgggaaaagttacgaattaatttatctctatctggcaaaccagccatagcatatttcctgaatacgtaaaaaataaaagccgactgctgaaagaatagtcggctttggtgttgcctgttgtgggtgcttagactctcaccccagcaatttttcgatacgctgtaatcctgccaccaaccgatcaacatcctcgcgggtattatacagcgccagtgaggcacggcacatactcggtacctgatagaatgccatcagcggcatcgcacagtgatgacccgtacgaatagcaataccgtattggtcaagaaagctgcccacatcataggcatggtgctggcccagattgaaggcaataaccccggcacgctctgttgggccatacagtgtcaggctcttaatctggctcagttgcgccaatgcgtaatgcatcagcgattgctcatactgttggatcggcaagagccccaattcagtgacatagtcaatggccgcgccaagccccatgatacccgcagtattaggtgacccagcctcaaagcgccaaggggcgtcagcaaacgtagtaccttgcgtcaaactgactgttttgatcatcgccccgcccccttcccatggcggcatctgttgtaacaacgcacttttgccgtacagaatcccaatacccgatgggccgtacagtttgtgccctgagaaaacataaaaatcgcagcccaacgcctgaacatcaactggctgatgcataaccgcttgcgcaccatccactaacaccactaaaccggcggcttttgcctgggccacaatatccttaatcgggtttaccgttcccaacacgttggagacctgagtcaccgccagtaagcgcgtggtgtcatcaatcaacgctgccagggcggttattttcaactcaccggtagccgtcagtggccaaacacggatttcaacaccaagatcttgcgccaacatctgccaaggcacaatattggcatggtgttccatttcggtaatgataatactatcacccgcggcaaggaaatggcggccataactgttagcaaccaaattgattgcttcagtggtgcctctgacaaaaataatttcttctgcggaggcggcgtgaataaaatcagccacctgagtgcgtacggcttccatctgctgagtcgcttcagcacttaaactgtgaatgcccctatgaacggccgcataaccatcacggtaaaaatgaagctccttgtcaatgaccgcctgaggtttttgcgcactggcggcgctgtccagataaaccaacggctgcccattaacctggcggctcaacagtggaaaatcagctcttacacgttcaataggaaaattcatacagactcccacgccaaacgctcagcaatacgtgctaacacctgtttacggatggcttcattgtggatagcttcagtcacttcagcagcaaatgcaaaaataatcatctgttgtgcatcagcctgattgataccgcgcgattgcagataaaatagttgctccggatcaatacgcccgacggtagctccatggctgcatttcacatcgtcggcataaatttccaattgaggtttggtatcgacttcagccaaatggctcaacagcagattgttgttggtcatctgcccgtcagttttcagcgcatgtttagcgactttaatcatgccgttaaaaatagctttgccccgctcacggaccatgactttatgcaactggcggctttcgcagtggcctttgttatgttccaaataagttcgggtatcacaaatctcgcgcccaaccggcagcagcaggctattcatcgataatgacgaaccttcaccatttaactggctgctggtgttatggcgcgttagccccgcccccagcaagaaactatgactccgcgcccgtgcatcacgccccaagaccagatcgttatgggcaaagtgataactcttcggcgtttcaaacgccaacttataatgattcaattcagcgttatcacccaccgcgattgtcagccgcgccccggtaaaatggggttgttcatcgaggctgacaaaatgctctataacttcagcctgtgcgttcgcctcaaccaccagatgatggcgagagtggctggtattcaccatatccgagtcgttacctgagctgatatgcagaaggtataagggcttgtcactgtgttgacctacaggtaaccgaatatgcaaacgttcctgcgccaaactttctgtcaggtgcaaaaacacctctgattgtatggccgtagggaacggcacattttcagccgcatgcgttaattgataaggaccgcactcacggtcacttaacgtcggcgaaaactggccattaatgaagaccaaacggtgagcattgggtaccagagacagtgcatcgcactgcgctgttgtcacatctggcgcatggggaaaactgaattcatgcgcgaataaacgctccagcggcgtgtatttccagtcttcatgtttactgccagggaaccccagttgcagcacctgctgccaatgggcgcgggcatccgcagagggttcgatctgacgctgcttaaacaactgaccgaaatgctttaatgcatcaatccgctgttgttcttgtcgctgctgttctagccgctgtctttccagaacgttactgttggtcggtaagccagccatagccttgctcctccaactgtttcactaacgtgaaatcacccgatttaatgatccgcccctgatacaacacatggacgaaatcaggtttaacgtaatccagaatacgttggtagtgggtaacgataataaatgagcggttctcattgcgcagtgagttaacgccattggccacgattttcagtgcatcaatatccagcccagaatctgtctcatccagaatacacaacgaaggctctaatgctgccatctgcagaatatcattacgtttcttctcaccaccggagaaacccacattgaccgagcgggtcagcaaatcagctggcattttcagcaaggcaattttttcttcaataaaatcagagaaatcaaagcggtccaatggcgcctgctgacgatatttacgcacggcattaaccgaggtttgcaggaagaaatggttactgacaccggggatttctaccggatactggaaagccaaaaagacaccttcccctgcacgatcttctggcgcgagttcgagtaagtcttttcctttaaaagtgacttcaccttcggtgacttcatactcttcacgccctgccaatgccgctgataaagtacttttccctgagccgttcggccccatgatagcgtgtacttcacccggtttgatctccagatctaaacctttgaggatttcattaccttcaacgctaacttttaaattcttaatacttaacatagagttccttggtgcgccgtgacgcaaaactttatttataccttcatctttcagacggcagggggttggcgctctcgttactcatcccatccgcgggcctcagctcgacgaggccgctgcaagcagcgttcctgcatgttgaaatctattaggtatatgcagcgaatacttactcagctaacaatcagccgacactgtgctccaaactaatggctaacaatttttgtgcttcgacagcaaattccagcggtagctcggaaaagacatccttacaaaaaccgttgacgatcattgaaatagcatcatcttcgctgataccgcgctgcaagcaatagaacagttggtcatcaccaatttttgatgttgtggcttcatgttccaactgtgccgtgttatttctgacttccacatacgggaacgtatgggcgccagaatctgggccaatcaacatagagtcacattgtgtgaaattgcgggcattgtcagcaccgggcaggatcttcactaaaccacggtaggtattctggctgtgcccagcagagatacctttggcaataattgttgatttggtgtttttgccaatatgaatcattttagtgccggtatctgcttgctgataaccgttggttagcgccaccgagaagaattcccccacagagttatccccttgcaggatcacactggggtatttccacgtaatcgctgagccggtttctgattgcgtccatgacatcttcgacccttcgccttcacacaacgcacgcttggtcacgaagttcagaataccccccgtactgtcagaacctgcaaaccagttttgcacggtggagtacttcacctctgcatttttgtgcagaatgacttcaaccactgccgcatgtaactgatagctgtcgcgcacgggtgccgagcacccttcgatatagctgacataactgccttcgtcggcgataaggatagttcgctcaaattgcccggttttagccgcattgatacgaaaataagtggagagctccattgggcagcgaacaccttttggtacatacacaaaggtgccatcagaggcaactgcagcattcagcgcggcaaaaaagttatctttagccggaaccaccgaccccagatatttctgcactaaatcagggtattcctgaatagcctcgccgaatgagcagaaaataatcccctggcccgccagcttttcccgataagtggttgctaccgagaccgagtcaaaaatagcatcaacggcgacttcagccccttctcgtaccgggatccccaattgggcaaaggcagactctacctccgcggtcaggtattcgttagcattgcttggcgcactcccgtcagcagaggattgctgcacggctccgggctgcgaatcacagttatcatcacatctgccacaagatggcgcagaataatagctgtaatcttggtaatccaaaccttggtaatgggccttcagccagtgaggttcttccatctcgagccaacttcggtaagcgccaaggcgaaactcaagcatccactcaggttcattacgtttcgctgagatagcacggacgacctcttcgttgatgccctttgccagctcatcggtggccaagtgtgtaaaaaagccctctttataccgaccatcactgacccaagcctgcacatcatctggaatttctacattgcttcgtgtcatttagtttgcatcactcaaacgccaaaactctcgccacacccgcaggaatgctgagctttaggattattaaatttaaaaatctggtttagcccttcgcggacataatccacctcggtcccgtcgataaacggcatcgcttttaatggcacgtaaagcctggcgctaccctgttcaaaaaccagatcatcgctggcaggctctttagccatatccataacataggcaaaaccggcacaaccggactgtttgacgccgagctgtaacccttttatttgtgggtcttgttgcataagccgcgtaatttgcgcagcggcactgtccgtaatcgtcacgccttgccagtcattatcgtcgagagaaaatgtcccaactgattcttgttgcatatgctctaccttatgtttctctatcacccgatgagttgttacttttccggctaaaagttattaggttaaacgttttcaggttgaaaatttgctggctgattattgatggatcaacacagattattcacaatggtagtgataataattatcacttcaaccgtttgttttgcagggatattaggaaaagtgccgttttgacctcgaatgaggtggcaacaagagaagcaggctgcgatacccaaggaggtctaaaagaaaaaacactcttttatcaccatgaaataaatcgataaatttcgtggtaatactaaaaacccttgctaagtcagaggccaatcatcctcagcatctgtggttttaaaacattcatagaaaatacctatttctgtattaactttagctgaaaaccgccatggaggaaacctcacgcaggcattctcaatattgagctggggaatgaggctaaatcaggaattaagtttcagagataagtgccagtgatagagagaggagcgcaaaacgaggattgagcctgccaaggtcaatggggaaccctgacaggagaacagaggctattggcaaaaaatgacgacgttagcgcgtcaatacggcgatcgttaagcgggaagtacaacacagatgtccctgctcatcaaaaatctcaatctgccagacctgatgactacgccccacatgaatagcacggcagcagcctctgacgttgcctgagcgtactgatttgaggtggttggcattgatctccaaccccaccacttgttgcccctccacggtacacagatagccggccattgagccaagagattccgccaatacaaccgaggctcctccatggagtagaccaaaaggctgagtcgtgcggctatccacgggcatggtggcctccagttcatcgtcagacaagcgggtaaactcaatccccagatgcccaaccatgcatccctggctttgctgatttagctgttccaatgtcgctgcacgcttccaaagcatttgttctctcctgttatcagttcaccaataagggccttatcattactcagtcttataagtatttaaccttataaccactcaactttataacgactcaactttataactacccagccccgtatcacaccagctcgagtaaagcttgcaacggatgccgcaggccattgccttcaatacgtttaacttggctacggcaggaatagccggtcgctaagcagcgtttacctggcaatgtttgcaatgcctgttgccatgatagcgcatagatacccaaagaattttcaacgttcttcgcctcatggccgtatgttccggccataccgcagcatccaacgctgacattttcaagccttgcaccatagcgtgaaaaaatggtggcccaatgctgactgctgccgggtagtgccgttgtttcagtgcaatgcccaaacagataccaaggctcaccactgatttgctgctctggctgatcagccagagccgtttgtaaccactcgtgaaccagttgcaccgtgaaatcaccccgtgcatcgcccaaaatttctttatattcgtcgcgataacaaagcaccaacgcgggatcaacccccaccatcggcatagctaataacgcaatacgattgaggaaatccgctgttttacgtgctgttttcgcaaaccgctgtaggaatcctttgatatgttgcgctttgccattgggtgaaaaaggcaataggacgggattaaaacccagcttttccaccagccggacaaaatccgccaccacttgggcatcgtaatagctggtaaatggatcctgcacgatcaacacatgctggcggcgttcttgctcgctcagtttttccaattgttccagcgtcatggtactggcgtaatggccggagagtgcctgcttcagcgttgggctggagagcataggcaaatcaaccataccaatgcttttctggcttaacgaccgcacccacgattgcttcaaaaagaaattaaagaccttgggtgccttggccatcaatggggcataactctccacccctgccactacgtagtcacgtaatgggcggtgatagcgggtgtgatacagttgaaggaaacgggagcggaaccccggcacatcaatttttatcgggcactgtgtcgaacaggctttacacgccagacagccagccatggattctttgacttcatgtgagaaatcatagaccccttgactggcctgccaactgttgcgggtcttttcaatcaggccgcgcaaacttggccgcttgctcgccaatcctttctccagagccacggggtcaacaccttgctctgacagtaatcgtagccactcacgcaccagtgttgctcgccctttcggggagtgaatgcggtcaccggtgattttcattgatgggcacattgggctatgcgcatcaaagttaaagcataaaccgttgccgttacactccatcgcaccacggaacgaggttctcacctcgagtggaatacgccgatccagcgtaccgcgtttgtctgcgctatcgatcttcatcatcggggcatcactgcctaacggtgagcagatcttccctggattcaatcggttgtcaggatcgaatgccgatttaatgcggcgcagttcgcggtataacacgtcgccgaagaaatcggggctgtattctgcccgaaagcctttgccatgctctccccataacaagccaccatagcgggcagtgagtgctacgatctgatcggagagttgtttcattagtctttcttgctgtggatcgcacatgtccaatgcgggacggacatgcaatacccccgcatcaacatggccaaacatgccatacgagagattgtggctatctaacaattgacggaattcaacaatatagtcagccaagtggtgaggaggtacgcaagtatcttcagcaaatggaataggcttcgcccgccctttgctgttaccgagcaagcccaccgctttcttgcgcataccatagatacgctcaataccggctaactcgctgcaaatctgataaccaattaccccaccttgtctggtggacattagctcatctaaacgttggcacagcgcggccatctgggtgtcgattaacgcggcatcatcaccggcaaactcaacaatattcagccccagcatctctttatcgggaacgtcagtgatcagttctttgaccgagtgccaaacaatatcttctttggctaaattaagaactttagaatcaaccgtttctaccgataatgctttcgcttccaccatgaaaggcgcattacgcaaggctgaatcaaaggagtcatacttcacattcaccaaacggcgaacttttggcaacggggtaatatccaacgtagcttcggtaataaaagctaatgtcccttcagatccggttaagatccgcgttaaatcaaaagattgcaggtcatcactgaacacgtgacgtaaatcataaccggtcaagaaacggtttaatttggggaatttctctaaaatcaatgcgcgttgttcacggcaacggttcaggacggtgtggtaaatacgccccaccaccgagtcttcctgcgcaatcgtttccgccaatgacgtcggcattgcctgggtgtctaacatctcgccacccagcaaaatagcgcgtaaacccaagacgtggtctgacgttttgccatacaccaatgacccctgaccggaggcatcagtgttaatcattccccctaatgtggcgcggttactggtagaaagttccggtgagaagaaaaagccaaatggctgcaagtactgattaagctggtcttttatcactccagcctcgacccgcacccagccttgttctgggttaatctccagaatgcggttcatatggcgcgacatatccaccacaatcccgcgattcaacgcctgaccattggttcccgttcccccgccgcgtggcgtgaataccaatgatttaaaactctccagccctgccaggcggccgacgagcgccacatccgccgttgagcgagggaaaaccaccgcatcagggagcagttgataaatactgttgtccgtagccatcgtcaggcgatcggcgtagttagtagcagtatcgccggtaaaaccgttttgcttcaaagcgtccaaaaaatccagtaccgactgaatgacacccggtgcctgagaaatttgtgggatcattagtgtgaccctattctatatatgagtttatttttaatgtatgcgcggtcatgttacgtgatttatgagtatcaaaccgtctttgcgcttctgtctttaaatgttatcgcacataccgttaccgctaagagattatccgttagcaataacctttgtcgaataatttatgtcaattcagaacgatgggaaagtgatgggtatcgacggagggcagatagggtaaaaatccattaaatatcaaaatattatattgtgcaaattgcaggcgtaataaattaaaatggcgctattcggccatgcttacgtgattaagtctactttttactacgcgatgacgttacagacttttatcattagaacagcacagtaaaatctggacatagacccaaaataattcaagttgcaggaagacggcgaggccaagtaacctgtagcccacacctgcaacgtgagaagtgccggggatgaaaagcagtaccggtataaaatagtgccgataaaaaatagtgtcggtgtgaacaatatgggtataacgcgaacggttctaacgcaataacggatataacgcaataacggatataacgcaataatagtgcaatggccactttgccatgattatcgaaatgagagttcactaatgaatgacccgcaacaacgtcttctcgatttacctaaactgatgtttggggtgatattcattatgggaatgattatcgccagtttttgggtaatacagccttttgtcatgggctttgcctgggctggtatggtggtcattgcgacctggccgctgttaatccgattggagaaacttctttggggcaggcgttcactggccgttgttgtcatgacgatattgctcattttactgtttgttattcctatcgcgctgttggtcagtagtttggttgaaaacagcgccccactgatccaatgggcatccagcccatcaaatctgcgtatgcccaatgtggattggatgaaatcgattccattgataggcgataaactttatagcagttggaataccttaatttctggtggcgctaacgctttaatggctaaagtacagccctacattggtgccaccgccacctggtttgtggcacaagcagcacatgttggctattttctgattcatctggccttgatggtgctctttagcgttttgctctatatccatggtgagcaagtcgccttaggtatccgtcattttgccatgcgcgctgccgataagcgtggcgatgccgtagtcgtgatggcggcgaaagcgattcgtgctgttgcgttgggtgttgtggtcaccgcattagtacaagccatactcggagggataggtcttgctatcgcgggtattcaatatgccaccctattgacggtattaatgttcatctgttgtgttgcgcaactcggtccattactggtgctggtacctgcggtcatatgggtgtattggacgggtgatacgacgtggggaacaatactcttggtctggagctgtatcgttggaacattagataacttcttgcgcccatatctgatccgtatggaagcagatatgccaatgattctgatcctctccggggtgatcggggggttgttatcctttggtatgattggtctatttatcgggccagtggtgttggctatctcatatcgtctgatttcagcctgggttcacgaaacgccagaacccgaagagagtgttaccgatgccgctaagcatttagaagagctttaaccctaaggggtttggtggttattctgccgaaccccttatattcagcatatattctcgattactaataatcctcgattttttataccccattaatttattataaaccactcatctaattagccattgcgccatctcattagtaataacaacctgaaactatctcattctacttcttatttaataatttttttattcagaggattcttaatgactaagccacggaatttacttaagattattattagttagattgcatctctcttaaggcgcttaaataaaccatttaatgatagcttatttaaacgtctgtgatctagtacatgtattgctgtgtgtagtctttgcctgtcacctaagacaggcttttttttttgctattactgctcattcgtcacttttgtctattggctacttttccttaatttcgatttccttgttatgaaccaattaattgttatgaaccaattaattgttatgaaccaattaagtgttatgagccaattaattgttatgggccaattaattgcaaaaaaatccgcaacctaagctgcggatgatgaatacctataaatactcgtctcaatgaacactcacattcactctcacaaacaaacactcatccctaaccctgagtgatcaatgtttggtgtgttgcgccaagctcagccaagttttcactacggtatctggattaagagacaagctgtcgatcccctgttccattaaccacagagcgaaatcttcatggtctgacggaccttgaccacaaatcccgacatatttaccgtgacgtttagccgcttggattgccattgataacaacgcttttactgcctcattgcgctcatcaaacaacgccgataccacgccagaatcacgatccagccccagtgtcaattgagtcatatcattggaaccaatggagaaaccatcaaaatgctcaaggaactgttctgccagcaatgcattagaaggaatttcacacatcatgatgatcttcagaccattctcaccgcgcttcaatccttgccttgccagttcggccactacggcctccgcttgcgccaccgtccgcacaaaaggcaccatcacttcgacgttagtcaaccccatcacattgcgcactcgcttcatcgcctcacattccagagcgaagcaatcacggaagtgatcagagacatagcgccccgcgccacggaaacctagcattgggttctcttcgtgcggttcataacccgcgccccccaccagattggcatactcattagacttaaagtcagacaaccgaacaatcaccggttttggccaaaatgccgcccccaatgtagcgatcccctcggtcaggcgaccaatatagaactcgaccgggtcgtcatagccatgcatcaacgctttgatttcagcctgtagcgcaggctcctgctgatcaaactccagaagagctttgggatgcacaccaatcatccgattgataataaactccagccgcgccagaccgaccccttcattaggtaaacgggcgaaatcaaaagcccggtccgggttgccaacattcatcatgatttttaacggtaaatcaggcagttcagtgacttgcgaactttgaaccgagaagtccagtagctcgtgataaacgtaacccgtatccccctcagcacaggagacggtaacattttggccctctttcaatagctcggttgcattaccacaaccgaccaccgcaggtatccccaattcacgggcaataatcgcggcatggcaggtacgcccaccacggttggtaacaatggctgaggcctttttcatgatcggctcccaatcggggtcagtcatatccgtcaccaggacatcacccgcctgaattcgatccatctcactgatgtcatgaataaccttgaccggacccgcgccaatacgatgaccgatagcacggccttccaccagcacattactttgattattcaactggtagcgttccatcacctgctcattggaacgcacggtttccgggcgggcctgcacgataaacaactgccccgtatgaccatctttggcccactcgatatccattgggcggccataatgttcttcaatcaacagcgcctgatgggccaatgcttctacttcatcatcactgagagcgaaacgattgcgttgtatttctggcacatcttcaatacacacctgcttgccatgctcttggttctcggcgtatatcatccgaatttttttggaccccatattgcgccgcacgatggccggtttaccgttacgcaatgtgggtttgtgtacatagaactcatcagggttaactgccccctgtaccaccatttctcccagaccatgcgctgcggtgataaagaccacttgatcaaaaccagactcggtatcaatcgtgaacatcacgcccgaagacgccagatcagaacgcaccatccgttgtacgccggcagacaatgctacgccgcggtggtcgtacccctgatgcacacgataagaaatagcccggtcattaaacagtgaagcgaacacgtgcttaattgcgaccattatcgcatcaatgccctgtacattaagaaatgtctcttgttgcccagcaaaggaagcatccggcatatcttctgctgtcgcagaagagcgaacagcaaatgatgcctcaggttcgccgtcagctaattgcttataagcgtcataaattgattgttcgaactctggatggaacggcgtctcaataacccattggcggatctgagcgcccgctttggataattctgcgatatcgtcaatattggtattatccaataattgataaatccgttggttgacaccactttgctccagaaagtcgttaaacgcctgagctgtggtagcaaagccattgggcacagaaacgcccagttcagaaagatgagttatcatttcacccagggaggcatttttaccccctacgcggtcaacatcgtgcatgccaagctggttgtaccaaagcacattacagcgggtgtggccattgttggacatcgaaacaatccttttacattgtcgattagttattacatcgtcgattagttattacatcgccgattagttattacaccgtcgattagttattacaccgtcgattagttattacatcgccgacgagtgacgaacagtctgtagggtacggacaaccgttatcgtcgctgaaaaatcagccatttcagactagcacaatgatccataacctatggacaggtgaatcgatcaacccaacaagaaaaattttttgttggctattcttgcgacaaaggctttacccgcagagcgaatgaggcacactgattccactcaacttatagcctatatcaacgtcattggcgttgtggcttggcagcaaatagtcaggagtcagcgtggaaagatgtgtattttatatttcggatggtaccgctatcaccgcagaagtactcggccatgccgtgctatctcaattcccgatcaacgtgacaacctttacgttaccttttgtcgagaatgccgcccgcgcacagtcagtatgtaaacaaatcaatgaaatatatcaggatacaggtgtcaggccgcttgttttctattcgataataagcctcgaagtacgggaaattattcaacgaagtgaaggattttgtcaggatatcgtgcaagcactggtcgcaccattacaaggtgagttgggcgtaccacctcaaccagtgctaaaccgtacccacggcttaaccgaaagtaatctggataagtacgatgctcgcattgcagccattgattatgcccttgcccatgatgacggtatttctctacgtaatctggatcaggctcaggttatcctgctaggcgtttctcgttgtggtaaaacccccaccagcctctatctcgccatgcaatttggtatccgggcggcgaactacccgtttatcgccgatgatatggacaatttgcaacttcccgccgcactgaagccttttcagcacaaactctttggtttgacaatcaaccctgagcggcttgcggctatccgtgaggagcggcgcgaaaacagccgttacgcctcactgcgccaatgcaggatggaagtgggggaagtggaagccttattccgcaaaaatcagattcgctacctaaactcgaccaactactcagtcgaagagatttcaacaaaaatcctggatatcttagggatgagtcgtcggatgttttaactaaatattttcatgagtgattatttgcggtttatttcctctaaatttgtataaattacagtgatgacggttgaattcatgtgattttggtttattgtgatcgccatcacttcccggtatttctgccgcagagaagaacagatttagagagttttcatgtacaagacagatgaactgcggaccgctcgcatcgatagcttgattacaccgcagcaactggctgaaaagttaccgatttctgaggttattgcagataacgtgacagcgtcacgtaaacgaatagagaaaatacttattggtgaagacccacgtctactcgtggtgattggcccctgctctattcacgaccttgatgcagccgttgattatgccacccggctcaaggtgctacgagaacgctatcaagaccggctggaaatcgtgatgcgcacctatttcgagaaaccacggactgtagtgggttggaaggggctgatttctgatccggcacttgacggctcatgccaggtgaacttgggtattgaactggcacgtaagctactgttagccgtgaatgaactcgggctgccgaccgctaccgagttcctcgatatggtaacaggccaatatattgccgacctcatcagttggggggcaataggcgcacgtaccaccgaaagccagatccaccgagagatggcctcggcactctcctgccccgtgggtttcaaaaatggtacagatggcaatgtgcgtattgctattgatgccattcgcgccgcacaagccagccatatgttcctttctccggataaaaccggccaaatgacgatttaccaaaccagtggtaacccctatgggcatattattatgcggggtggcaagcaacctaactatgatgcctctgatatcgcagccgcctgtgacagcttgcgggaatttgatttgccagaacatctggtggtggattttagccacggcaattgccagaagatgcatcgccgccagttggatgttgccgaaaatatcgggctacagatccgcgcgggttcaacagcgattgtcggtgttatggctgagagtttcctgattgagggcacacagaagattgttgccggacagcccttaacttatgggcaatccatcactgacccttgcctgaattgggatgatactgaacaactgttaagcctattggcagatgcagtaaacagccggttttaattcattcgcacgggctttaatgagtaaaccgtacattaaatgaataccttcgggatagggaaaagttaacgttgtcgggttaactttttctatccctattttttccgaaaaaacagcgatctattctctgtaatggcgcacattacaagtgccaaatggaataaaaattcagctggaacaagagatctcgaggtgttttccccaatctgggggtaacgccgctaaatcatcaaattcaggttgatcagtaaacggttgctgtaatgcctggtgcaaccgctgaagtggctgaatatcatctttttctgcctgagtaatcgcctgctgagccaaataattacgtaatatatatttaggattagccgctttcatcgattgctggcgctgatcatcatcgatggattcttgctgcaaccgtgaacgataacggcggtaccagtcgtcaaaagcggctctatcgataaagtcatcccgcaatggcgattgtgcagagtgtacttcaacttcgctcaataagcggaaagtccgggtataatcccggccttctttgatcatcaaactcaacaaacctgtcagcaaatcgttatcttggctgtcacgctcaagaaaacctaacttggctcgcatctgttcaccataagcaaccataagtgccggttcataagcctctagcgccaactgcaattggtcagcagacattaaacctgacaacgcgtgccccaatcgatgcaaattccataacgctacggcaggctgattatcataagcataacgcccttgatggtcggagtggttacagatatatccaggcacatagtcatcgagaaaaccaaatgggccataatccatagtaatgccaagaattgacatattatcggtattcatcacaccatgagcaaacccgacggtttgccagtgggccattaaacgcgcggttcgctctaccacatccgtaaaccacagtcggtagcattcttggtgccccacccactgcggccagtggcgggcaataacataatccgctaattgttgaacttgcttaggttgctgccgatagtagaaatgctcgaaatgaccgaagcgaatatggctttccgccacccttagtagcatcgcgcctcgttcagtttgctcacggtagattggatgatcgctagtcacaattgtcagagcacggctggttggaatacctaaatggtgtaatgcttcggaggccaaaaactcacgtatcacagaacgcaagacagcccggccatcccccatacgggaataaggtgttaatccagcgccttttaaatgccaatccatatagcggccatcattaagccgctgttctcctaacaagatcccacggccatccccaagctgccctgcccacatgccaaattgatggccgctatacacctgcgctagcggctccattccgggtaacagtgcttcccccgcccacacagcagtctttggttcagtgaaccaatgagcatccagccctaactcttgcgccagaggtttgctgtgatacaacaagcgggcaccttttaatggcgtaggttgcaagcgggtgtaaaaaccactcaactgccgcgcatagctgttatcgaattcaggggcgtattccattctgggtttcatctctatgtccacgagtgctgtgcgcggccaataaccacggtaattgaaagattagcgtaatacttctaccagccaatggcaggcttgctgtaactcggtttgtaattcagggaaatcatcaatccagtgctgacagattttatcgatagcatcagggcgataagctgccccctgtagccgttgcgctaacgcctccaatggcgtggggttcaagctgtcagtaaatatttggcagcgatctattgcgccgtgcaaaacatcaaaatgtaactcaatacccccccaggtaaagcgggtatcaaccacgtggctaaatgcaggggcttggccaaaattccattcccaactactttgtttggcgaattgctcggtaaagccagggaggtttggtaacgactgcggagagatgacttctgcggatacctgctcatcgtaataagcaaaaaaagcctgttcgatagcggtacgtattttttcgtgatcaatacccggtaacagttcgaccagattagtgactctggagcgtaccgaggtaattcctttagcctgtaactttttagggtctggattgagataatcagccaggcgactgagatctgcattcaataatagtgttccatgatgaaaaccacgatctttggtttctttataagcagaacctgaaactttacgttcatcttcaccattaataaccactaaatcattgcgacctgaggccgttgcctggatccctaatgatgccaacgcattcaaaataatttgggttgaaatagttttatcatatcccggtttgccggccataaaggtaaaacaggtattacctaaatcatgaaataccgccccgccaccactgctacggcgcgctaactttacgccatcttgttccatacgtcgtgtattacactctttccacgggttctgtgcgcggccaataaccacggtatccgcattgcgccacaagaataatacccgttgatccggtgacatttggcgaaaaatacactcttctacggccagattaaaccaaggatcataagaatcagaaatgagtaaacgaagggatgacatagaaggctccgacccaaaaataaacagccactaagatagcatattcgctgatgatatccttaggccgagaagagagggactgtcgtcgtcaactaaaattgcctattatcctgtcgagagaaaatcaaatacgccgtgcctgccagtaaactcgtttccagtacacattctccaatgacgagcgaatgacgcctttactggttgaagcatgaatgaattcatcattggtatcatagataccaacatgtaatccattctgaccactgcctgttttgaagaagactaaatcgccaggcatcagttcatcacgagagactttagtgcctaaggtggtttgcgcaagggtcgttcgggggagttgcatatcaaaacgatcacggaatgtgcggtaaacaaaaccagagcaatcaacaccacgttgatctaaccctccgttacggtatggcgttccctcccattgccgtaactgctcattcaatttagcgaccaccacaatggagtcagataagtatccactgggtgttggtgtatggctgctacaaccagcaaggaccatactgatcagaaaaatccaaaagcgcgtccgcatcgctatttcaccagagataaggctcagctaattcgccaaaaagtcagttattcaagcctcacttctgacctgaagttgcagccgtattcgcagcgtttactcacccgaatcacggcgttttgaacagctcagccggactcgcatgtttactgccttactgcacacctaacgactttaggtatatatttagctggcgtggtacatcgttacggctaatttagctatcggattcgaaaaaaacaagttatatgaatagactaatagggttagtaaataagattagctagcttttataggttttatattaatcagccatattcctaataaaataaaacccgcccccagtgtttttagtaaggtcgcgggttcgttaaaccaaggtaataaaacagcgcccagataaaccaaagcgtaactgaggctcagcagtgggtaagcgcgatttagcggcaagtatctaagggcaaaaaaccaacataacatggataaagcataccccatcaaaccacacattactgatgctaattgcacgaagtacatcgtcaagaattgaacattaatatcggctagtgataataatggaatattcatcataccccacttcaacaccaactgtgccaccgtgaccaatacgacgcttgcccccccccacagataccctttcataggtgccaactcattagcaagataccgaatataatagcggcaacccccaaccaatgccgaagagtggccttttcaccgtaaaatagttgtgccgccaaggtaaccaacacaaaattaaagctgagcataggataggccacgctcagcgggagttgctgcaataaccgcagccacaacagcatccccaagccaagtgacactacagctatcgccaaccaacgcaatgtcagattcaaccgccgggcctgcggttgctcccaacactgcgcagcctgtttttgacataattgcccaatacaggttaatagactgaccatcagcaagagtaggtagctgttcatggtgttttctggtaccacaacagggcgagtcgattcattaaattcaccttatccgctggcggcagatgggccgggagtgcttcatttttggctaattgcacgaccaatgagacgtcgccttcttttctcgcctgcgcaagccatgtggggaaatcgtcattactgatataattatcctgactgtctgggtaggccaaaccataggttagctcacctttttcactgaacatcagtatatcactgcgttttagctcccatgccagcccagcggcaacaccaacgctgtcggtcagcacatagcggctggagctgagttcactaaaattatttttgataaagttttgcggttgctttgagtccaccacttgttgtggaattaggtaacccactaacaaaatgaataacagtgggcaagctgctgcccagcgccagtttcgggcgttattgcgtaaggtaataaacccagtgactccccaaccagcaaatgccaacacacctaaccaaactttctgattctcttgcggcccataagccacgatatccttcactaaccccaagccaataacgacgatgactaacgcacaggcaaccccgaagagtagatttattacaccgtttattttcaatgcccgcatacgtatattattagcgcaatccgtcgcatatgccgccattagcaaggatagaggtgccatacagggcaaaatataagtcggtagcttcccttttgctacgctaaaaaataggagtggcataaccacccaactgagtaaaaagaataattctggttttgttgcccgctcacgccaacctttaaataaggctccaggtaatagccctagccaaggcaggacaccaatacataaaatgggtaggtaataccaaatgggagatttatgttgagcactcgcttccgcaaagcgctgaatatgttcaacccaaaagaaatagttccagaaatcaggttctcgttgggcgatcgccaaagcccacggtaaacttaataataccgcgcacacaattgctatcggaccaaaaacaacaaggtcttttatccttttttgctggatgacaatgggtaataccgcaatcaccgggaccgctaatgccagaaagcctttggtcataaaccccataccgcaagcaaccccaagtaatgcatatgcgccgactttctgttgccaattttcggcttttagcgtgagataaaaactcaccatcgccgctgtcaaccacagagaaatcatggggtccagcactgcataggtaccaatgccaaacaccaataaaaaggaaagataaattaatgtagccagtaccgaggttgaccgattacgccataataaggttgccagccaataaactaatacggcactcaatgccgtgctaaaaatagagccaaatctcactgcaaaattactgtcaccaaagatccattggctaatgttattaaaccaatacccggcgaccggtttttcaaaataacgtatatccatgaaatacggcacgacccagtcgccacgctgcagcatttcacgactaatttcagcatagcgagtttcatcgggttgccataacaaacggctattcaccggtaacaaataaaccaatacaaaaaatagcgccaataatgctgcgccactgtcttttaataatttcattcagcatcctttatgtctgattgacaacccaaccaaccttcccggccaggaaatgcagcgcgtattactttgcccacaggcagtaattgtaaatctgacggtagcagcttactgagcggacaaaactcaatatcttgttgctttgctctcatcaagagctgctcaaacattgctgcctgagacatcccctcaacttcagcatgaatggtgtataccgataccccgctatcacgtaggatggcgtcaataataaagtcattgaagttttcagcttgcacctcaccgccgacaacttcatcgtaagttggcagcgtcacgggaatttgtacactccctaagctgccattaggcaacaaaggccggaaaggatgggtcccccggcaatcgctgttataactaaaatcgaattgctgttttaccgcaagaacccgttcatcggcgcgccaccccgcagcagcagaacagctaatgggttgaccaatactctgctgtaaagtatcaactcctctctgtacttgctcagtcagttgttgctgtgaccatgaagcgacgttggcctgccagccttgatggtcccaagcatgcaaccccacttcatgccccgccatggccgctgctttcattaacggaccaaagtctttagcgatcttcttacctggccaagccgtgcccgccagtaaaatatcccaaccgtaaagcgaggcagcattagaacgtagcatcttccataaaaagcgcggacgaaaaaggcgccataaatggcgtcccatattatccggcccaacactgaagaaaaaactggcacgaatgtcatgtttttctaaaacagtcagtaatgatggcaccccgtactgcgttcctcggtaggtatcgacatcaatcctcaggccaacttgcttcatgcgttcaactcatctttaggggctgcagttttctcaattacggcagcgcgcaagaaaaagtccagcgtctcagtgaccgtttgttgcatagcaatttctggctgccagtgcaatattcggcgcgcattcttaatacttggcgtgcggtactcaacatcctgataacctttcccataatatgcactgctctcaatatctttaaaacctgcaaatggcggaaagtgatcacgtaattcatgattttcgaagctcgttaacagcatttcggctaattcacgaatactggcttcgttagttggattaccaatattaatgatctgaccatcacagcaaccatcccggttttcaataatacggaataacgcttcaatgccatcgtggatatcagtaaaacaacgtttttgggcaccaccatcgaccagcttgattggtgagccttcgaccaaattcagaataagctgtgtaatcgcacgtgaactaccgatacgcgcagcatcaaggttatctaaacgtggccccatccagttaaatggacggaacagcgtaaacttcaaaccttctttcacgccgtaagcccagataacccggtctaataactgttttgatacagagtaaatccagcgttgcttattaattgggccaacaatcagccgtgaagtatcctcatcaaactctttgtcatcgcacataccatacacttcagaggtcgatgggaagacaatacgcttattgtacttaacgcaatctcgcacaattttcaggttttcttcaaaatctagctcaaagacacgcagcggattacgggtgtattcaatgggtgtcgcaatagccactaatggcaagatgacgtcgcattttttaatatggtattcaatccattccgaatgaatactgatatccccttccacaaagtggaaagcagggttacctaagaagcgacttatcgcgtcagagccaatatccaaaccatatacttcgtagcgatcatcttgtaataagcgttcagtcaaatgattaccaataaaaccatttacccccagaattaacacacgggtacgtcttttcaacgtattgcttggcttattacccaaacgcacatccgttacaatgcccatctcttgtgctaaacgatccccttggacatacagaccggcctcaccttgccccgtaataatctccagcgccccctcgccacatgccacagtgagtggggccgtcgataacacggtgcctggcaatttgttatgtactaaatctaatggacgtgagcgccaaatcgtaagtttgcgctgccccagataactgaatgcgccagggtaaggctcagtcactgcacgaactaaattgttgatggtaaatgcagatttctgccaatgaatttcaccatcagccgccgtgcgccgaccaaaataactggcatctgcctctttttgcggagtcagcggcagtgggccctctttcattctaggtaataagttacgcaacaattcttgagcggcatcacgcattttggcatgcaacgtcaatgccgtatcaacatcactgatggcaactttatactgaccggcaatcggacctgcatccgctttttttaccatctgatgaagcgtcacacccgtctctgtttccccattgaccaatacccagttaattggggctcgaccacgatactggggcaataacgaaccgtgtaagttaaatccgccttgtggggccaatgacaatatttcatcactaagcatgttgcggtaatagaaggagaaaatgatatccggctgtaactcacgaatacgctcaacccacaaagggtggttgacatcttccggtgcaaatactggcagtgccagatcggctgccactctagcgaccgaagagaaaaagcgattctcgccaggattatcagtatgggtaaataccgcctgaatatcgtaacccgcctctgctaatgcgtttagacccacgcaaccaatatcatgataggcaaatacaatcgctttcatttttctacatcctgattattttcggtctgctccgcgccgaccactttctgaacaaagtaacgtgggcgagcgcgcacatcgttataaatacgaccgatatattcaccaagtaaccccataccaacaaactgagcaccgatgaacatgaacaatacggcgaagagtgtaaaaacgccgccgccagcccactcaggaccaaagatcaagcgtaaggccaccagcagcactgagaaagtgaagcccaaaagagcaatggcactccccaccagacttaacaaacgtaacggcgtcgttgtcaggcaggtgatcaggtcatacatcagattgataagcctcatcaggctatatttggagttgccaaattcacgctcggcgtgatggaccgtaatctctgtcgtccgccgggcgaaggtattcgcgaggattgggataaacgtactgcgctcgtgacagtgtaacattgcttcaacaatgtgacgtcgataagctcgtagcatgcagccgtagtcacccattgatttccctgtagcacgttggatcatcatattgatcatacgcgatgcggttttacggaacagggagtcttggcgattagcacgcacggtaccaaccacgtcatagccctcttctgctacatgaactaaacgtggaatttcttcaggcggattttgtaagtcagcatcaagtgtaataattaaatcaccgctaacctgattaaatcccgccataatggcggaatgttgaccataattacggtttagcaaaatcgcaattatatggctatcaggatcatttgccgcagcagtcaaaagctcagtagaattgtcgctgctaccgtcatcaaccaaaattatttcataagcttgtgtaagtaatttacaggcagccgtcgttctgtctattaatgctggcaagctctcttgctcgttatagacaggaataacaatggagaccttcttaattggttcatttagtgacacggtgtgaccctataattgttgttaatgcattagccactcgttcaatatcactgtctagcatatcggggaaaagcggtaacgtgcacaatctggctgagttccattccgtgttgggcaaacacaaatgcggataacgttcgcgataatatttttggctatgtaccgcacgaaaatgtagcccactgccaatacccatatctttcaaacacgccatcagttgatcccggctaataccacagcgttcttcatcaacacgcaccatgaaaaggtgccaggcatgttgatgagaatagtgaggcaaggccaacggctgcaaaggcaaatgcgctaatgccttatgataggaagcaaccagcgcctgccgacgggcgttaatttcgggcaaacgtctaagctgcaccaccgcaatagcggcgtggatatcagataagttatatttataccccggttccacaacttcagcctgtgggctacgcccctgtatttgtcggtcaaaggcatccacacccaggccatggaacttaagccgacggactctggccgccaattcatcatcatcggtggcaactaatcccccctcagcacaagtgatattcttgatggcatggaaagagaaaatagcggtaccctgctcaccaatccattgatctcgataacgagtgccaacggcatgtgcagcatcttcaatcagtgggataccatgccgttgggagatctgacgcaatgcgtcaaggtcgcagggcgcgccagcatagtggacgggaataatggctttggtgttgggtgtaatcgccgcttcaatagcagccgcatttaccatcaatgtatcgcgatcaacatcgaccattacgggttctgcacccagcaacacgatcatgttaatcgtagaaacccacgtctgtgatggcgtaataacctcatcaccagggccaatgcccaacgccagcaatgtaatgtgcattcctgctgttgcagaacatacagcgatcgcatgtttgcaaccaaaaatttgacagaaatcagtttccaattgatgattctggggaccggtagtaatccaaccagagcctaatacattagcaacagcattaatttcttcactacctattgctggcctagaaaaaggcaaaaaactctgcattaataaatcccttaggacaccttcatggactattaactatatgcccagataagttaacgaaaactaaacgccaatcagataagagcgtcacctgctatggttaactttagtttactaaccttaaatgaaccttaggaagacactattttattgagggggaaaacaattattagcccagtaatagtaatgatatgttattcattttaatcaatgagttggatttaacgctataattgcgttcattatttatactgataatgtccacgataaaataacatcgtaagcacaatgatctgatgagaataggagaagtaaataatattttattgccaataaatatatctaagcgttatacgcttcttgtggtaatccactgctgtttattaaaattgtgtatttgaaaatcaacttcaaatacttgggagagcacatccgctcgcatgacttgctgggtttctccttgcactaatacttgcccttgagccagcaaccatacttcgtcagcttgctgtaacgtatggttgaggtcatggccactgatgataacactgcgccctgaccgacaaaattccactaataaagcatctaaagccactttctgggcaacatccaggccactatagggttcatccagcaacaataatttactgtcagggttgatatccggccaaacctgcaaaaataccgcagctaaccgcacgcgttgccattcaccacctgaaagatgtgacagcattcgcggtaatttgtcggttaaacgcagcttattacagatatagctaatcgctgttgccacagcctgtgaattagcaccggcgggttgataaagagaaagatattggaaaaccggcatcagggacaatgcggactgctgctgagataaataggcccgttgacgggctaattcatgcccttcatagtgttgcaatgatttacccgctaacacaatttcgccgctagcaggcaataaccccgccaacgaggccagcaaagtgcttttccctgccccattcgggccaatcaaatgaatttgcaaccccgtggtcacctgcgaagaaaaagaagcaaggcgggttcctacgctgacattgttgagttgcaatagcatcaaaataaactcgttacccgtaatttagtggctagccagtgcctgattgatggcattgattaaaataggtgcttctggtgccatatctggagcaaaacgcgccaagacagtgccatcacggctaatcaagaatttctcaaaattccataggatatcacccggctgttttggctcacggcctttactcgccaggcgttgataaaattcacttccttccggtttcactgcaacaggcttagcagtaaccaagtgctgatatagaggatgccgatgtggaccattgacttcaattttactgaacatggggaagtcgacaccaaaagtaccacggcagaaagcatgaatttcctcatcactgccaggctcttgtcctgcaaactcattactcgggaaacctaaaacctcaaaaccttgcttctgataggttttatagaggctttctaatccttcatattgctgagtcaaaccacattgcgaagccacattcaccactaataaaacggaacctttatacttcgccaacttaaccagctggtgatcaatcgtttgcactgaaatggcgtaaattgggtgactcatcaggttggatccttattcagtaatgataataaaccggtaaaatcaccgcggcatttataagaagacaaatcactttactcctttcacccgtatcagtaaccagataaataatggcgatcctaatgttgcggtaaccacaccaatcggtagctctgccgaagataataccgtgcgagcgacaacatcagctaataataatacccccccgccggcgaatgcacagcccgctaatagccggcgctgatcagttaaaccggttaaccgtaaaatatgaggaataaccaagccaataaaactgatgacacccgcgagtgcaacactaatgccgaccagtaatccgatcgccagtactaataaattccgccataaatgaagcgacacccccaattgcctggcctgctgctcaccgagtgacatgaagttcaggacacggccttggcagcaaagccatatgacggtaggcaagagagccagcaccaaactttgctgacgccagtcaacaccgctgaacccacccatcatccaatacatgagctgacgtaaatccaaactggtgctgaaatagacggcccaagtcatcattgcactgcaaataatacctaaggctacaccgaccaataatagctgggcattagttaataaacggcgacgggtgaaacttaacagaatagatgtcatcaacaatgcgccaataatagcacacgtgctcagaacccaaattggcaataatccatgacctaataatacggccgtcaccaatgcaacacctgcgccatttgccacgccaagtagacccggttcagctaacggattttcaaacagtgcctgcatcacagcacccgacacggccagactggcaccaaccataattacagccatagatcggggcaaacgtagttgccaaacaaataatttgccactttcactgaaccagtgctctggccaaatccagacatcacccgcacataaactgatgagtagcgcgaacaaaagcatgacaaccagcccagtaagataacgatagtcgcgctgccgctgccgttgttgaagtgcggtaaataactgacttgtctgcattacaccctcggccattacccaagacttacccgaataggtcgggtaaacatacaagggcctactgcccattctcaggcactgatattagggggttagagcgtgaaggggaagttgtgcgtggcgaataacgctctttattgctaaaacgctctttattgctaataagtcgctaactctgcttggtcatagcaaacaagtaaagttagcaactgtttgttatgctcgattaacgatggccatgattatcctgttgagggtagacctgttgagtgtcagggcctgcattattgcttatagtcctttggccctgcccattacctcccttattattgtcggaatgcttctggggcccctctccgcgtggtggttgaggattattattcatgccattaccacggtcttgctcacgaaacggattacgcccttgttgtatttgcggtttctgccaacggcctccatcccaagagtaaccacgttcattacgctcaccaatgtgagcgccgcgatgatctttccaccactgtggtggttgccagtcgtatccatcccagtaatagccacgtttatcttgatcacccaaatgcagattgatgccgggcatgttgatatcaagtgaaacatcagactgcgcaatcaatggcataaatgacagaaccccaaataataacaaatattttttcatattattccgaatatattattgaatcgttgataaacttatatcaacgaaaaaaatactcagccagtggttaatttgttattttcaattacatgtcattcaaatcacacaatccttacagttgtttcattgtgatgattttattgactactgaacttcacttatctttacattcaacaatgctgagtaatttataattcccgcttttttttaaccaaattaggaaggatagccccaacctgcggttatagtgtgaacactcataaaataattatatttcaacaaattcttgaaaagaaaaaggccgcttgcgcggccttttatgtcggaaactactcactcttttggagtggcactctctacccggcttttcagtttctgcccaggacggaaagtcaccacacggcgcgccgttataggaatatcctcacccgttttagggttacgccctggacgttggttcttgtctcgcagatcaaaattgccaaagccagacagtttgacctgttcgccattctccagagcacgacgtacttcttcgaagaataactcaaccagatctttagcatctcgtttgctaagccctagcttttcaaacagatgttctgacatttcagctttagtaagcgccataggttcaatccctcaaggatgcttggaatcgctgttttaatgcctctacgcattttgcaacggtagcggcgatctcctcttcttccagtgtacgggcggtatcctgcaacaccagactaatagccagactcttatagccctctgctacgcccttgccacggtacacatcaaacaagtttacgccaactacctgatttgcgccaactttcttacactcggccaaaatatcttctgcgggaacgttttcagccaccacaacagcgatatcacgacggttcgccgggaagcgagaaatctctctggcctgaggcacagcgcggtctgcaagcttattccactgcacttcaaacacgacagttcgaccattcagatccagcttacgttccaattctgggtgaactacaccaatgaaaccaatgtgttcacccgctaaataaattgcagcactctgcccagggtgcagagcagaatgcgcttctgcccggaactgaacatcagataatttgccggtaagctccagaattgcttccaaatcacctttcaaatcatagaagtcgatcggctgacgcgccagatcccaatgctcatcgtaacgatgaccagcaataacacctgccagcattacatcctgcctaatgcctaaatctgccgtattatcaggaacaaagcgtaaaccgctttcgaataatcgcagccgagattgctgacggttctgattataaacgactgccgacagcaaacccgttagcagtgataaacgcattgcggacatatcaactgaaatagggtttggtaaaatgagggcttcctgttgtggatgcagtaacgcctgtactttaggatcaacaaaactgtaagtaattgcttcctgataaccacgatccaccaaagctgtctttacccgcttcagcgacaagcttgcttcacggtgtttagtcattaccaaatcagctctaacggggacatctggaatattgttatagccataaatacgggcgacttcttccaccaggtcttcttcgatagccatatcgaaacgccagctcggtgctacagcctgccaatcagaaccacattcagtcactttgcatcctaagcgacgcaaaatatcactcacctgttcagatggaatatgatgaccaattaggcgatccagcttctcacggcgcaatgtgatagtggcttgtttgggtagttctgatgctgtcgtcacatccacaaccggcccggcttccccaccacaaatatcaatcagtagacgtgtcgcacgttcgatagctttatgctgtaacgctgggtcgacaccacgctcataacgatgagaggcatcagtatgtaagccatggcggcgtgctcggccagtaatagacagtggattgaagaacgcggactccagcaatacatttctggtttcttcattgacaccagaatgttcgccaccaaagatacccgccatcgccaatggtttctgatgatcggcaataaccagtgtgtctgcgttcaacttgacttttgtaccatctaatagcgtgagttcttcgccttcagttgccagacgaacgatgaccccgccactgatacgatccagatcaaaggcatgcattggctgccctagctccagcaacacaaagttggtcacatcgacaacaggatcaattgaacgaatgccacaacggcgcaatttttcacgcatccataggggtgtcgcagccttaacattaattcccttcaccacacgtcccagataacgtgggcaagcttgtggtgcatcgacacgaataggaagtgtgtcattaattgatgccacaacttcagccatatccggttcagttaatggcaattgattaacgacagctacatcacgagcgacaccaataatccctaaacaatcagcacggtttggcgttacgctgatttcaatcgtcttgtcgtccaagtgcaaatactcacgcacatcgacaccaatgggagcatctgcgggcaattcaataataccatcatgatcgtctgaaatagccagctcagaaaaagagcacagcatcccttctgaagactcaccacgcagtttggcggctttaattttaaagtcacccggtaataccgcccctaccgttgcaactgcaactttgaggccttgacggcaattaggtgcaccacaaacgatgtctaggaggcgatcaccgccgacatcaattttggtcactcgcagcttatctgcatttggatgttgcccacactccacgacatgacccacaacaacgccgttaaactcaccggcaaccgcgtctacaccatcaacctctagcccggccatggtaatctgatgagctaaatcatcgctgctaatggctggatttacccattcgcgtaaccaaagttcactgaatttcatgagatatcctgccttacttaaactgtttgaggaaacgcagatcgttttcgaaaaatgcacgcaaatcggtgacgccgtaacgtaacatcgttaaacgttccatacccataccgaatgcaaaacctgagtaaatctcaggatcgataccgacattacgtaatacattcgggtgcaccatgccgcagcccagcacctcaagccacttaccatttttacccattacatcaacttcagcggaaggctcagtaaacgggaaataagatgggcggaaacgaatttgcagatcttcttcgaagaagttacgcaagaaatcgtgcagtgtgcctttcaaattagtgaagctgatatcgcggtcaacgattaatccttccatttgatggaacatcggtgtgtgtgtttggtcataatcgttacgataaacccggcctggcacgataatacggattggcggctgttgctcttgcatagtacggatctgcacgccagacgtttgcgtccggagcaaccgggttgcatcaaaccagaaagtatcatggtcagcgcgggctggatgatgagccggaatattcaaggcatcgaaattatgatagtcatcttcaatttctgggccagactctacagaaaaacctaactcaccaaagaaagtttcgatacgttcaattgtgcgagtaacaggatgtagtcccccattctccatccgacgccccggtagcgagacatctatcgtttcggcggctaatcgtgcattcagaactgctgactctaacttctctttacgcgcattgagcgcttcctgtacttcttgtttggcctgattaatgacagcaccggctgctggacgttcttctgccggcaactcacgcaacgatgtcatttgaagggtcaagtggccttttttacctagatattcgacgcgtactaaatccaacgcggcaatatcttgggcatcttctacggctgctttagctttggcaaccagctctgcgagatgtggcattgttttctcttcctctggccggtatggcccgcttgtagttatatccttttttcttgacgctgcggggatgctagccctcgaatcacttactgatcatagccttaaaaaataagtaagctcatcgggattgactcgcttgctgcctacaacgccaataactttggatatatataatgaataagttaaaaactgatgaccgaaataaatttcttacgcaaaattagcaagatatcccattcgcgccctccccactttagtcaccatctgtgccgtaaagtaaaaaacaaaaaagcctccacgatgggaggcttcggcgctatttttcgtttctattcttacgcgcaagcctcctgtaatcaggcgctaaagtaaaaaaagaagcgaaaaataactgtatgcatcataacaatgaccttatggaatctgtatatcgcaattcagtttatagctaagtgcaaagattaaaagagggagacaagctccctcttcaattctgacttacgccagagctgctttcgctttttcgaccagtgcagagaacgccactttatcgaatactgcgatgtcagccaagatcttacggtcgatttcaacagaagcctttttcagaccattgatgaaacggctgtaagacagaccattttgacgagcagctgcgttgatacgtgcaatccacagttggcggaattgacgcttccgttgacggcggtcacggtaggcgtattggcctgccttgattactgcctggaaagcaacacgatatacgcgcgaacgggcaccatagtagcctttcgcctgctttaagatttttttgtgacgtgcacgtgcaatcacaccacgttttacgcgagccatttacttctcctatcgtcttaattcaaaccaaaattacttatgcgtacggcagacatgctacgaccagacccagatcgttcttagataccaggccttttggacgtaaatgacgtttacgcttagtagcttttttggtcagaatatgacgcaggttagcatgcttacgcttaaaaccaccattagcggtctttttgaagcgcttagcggcgccgcgtactgtcttaatttttggcattgaatatatccacttcgcattgttaattacaacgagctagctaggcgaacaggtttcttactacgcaagcgtagagaaacctgctacttgaatgccttactgtctcttcttaggtgcgagcaccatgatcatctgacggccttcgatacgagtcgggaaggactcgacaacggccaaatcagaatcttcacacagatctttacggacgcggttaagcacttccataccgatctgttggtgcgccatttcacgcccacggaaccgcagggtgattttggctttatcgccatcttccagaaagcgaatcaggttgcgtagtttgacctgatagtcgccatcatcggtaccaggacggaatttaatttccttaacctgaatgactttttgcttcttcttctgttcttttgtcgacttgctcttctcgtagaggaatttgccgtaatccatgatacgacaaactggcggctcggcattcggactgatttctactaaatcaacaccagcttcctcggctttttcaagagcttcattcagactgacaataccaatctgttcaccatcgacgcctgttaagcgaacttctgtggcgcgaatctctttgttgatgcgattaggacgcgccggttgaactcgttttccgcctttaatactttattcctccagttgatgaagactacggctgcgaatttctgctagcagctggtctacgaccacgttgacgtctaaacttcctaagtctttaccgcggcgagtacgaacggcaattttgcctgattcgacttctttatcgccacagaccaacatatatggaacccgacgcaacgtatgttcacgaattttaaagccaatcttctcatttctcaagtctgcttttgctctaatacccgcatcttgcagttttttggttacttgctgaacataatcagactggctatcggtgatattcatcaccacgacttgtaccggagctaaccaagttgggaaaaagcccgcatattcttcggttaagataccgatgaagcgctccattgaacccaaaattgcccggtgaatcattaccggcacctgacgatcattgttttcgccgatgtaagacgcacttaagcggcccggtaatgagaaatcgagctgtacggtaccacactgccacgcacgatccaaacaatcatgcaaggtaaattcaattttcgggccatagaacgccccttcgcctggctgataatcaaacggaataccattttcagtcagcgcagcagccaaatcgtcttcggcacgtgtccataactcatcactgccaatacgcttttcagggcgggtagatagtttgacgacaatcttctcgaagccaaaggtgctgtacatgtcgtacaccatcttgatgcaactgtttacttcatcacggacttgctcttcggtacagaagacatgggcatcatcttgagtaaagccacgaacacgcattaagccatgtagggcgcccgaaggttcattacggtggcaactaccaaattcagccatacgcagcggcaggtcacggtaagatttcaatccttgattgaaaatttgtacgtgtccggggcagttcattggcttaatgcagtactcacgattctccgaagaggtcgtgaacatatgctcggcgtagttttcccaatgccccgttttttcccacagtacgcgatccatcataaatggacctttcacttcctgatactggtactctttgagcttcatacgcacaaaggtttccaattcgcggaaaattgtccaaccatcgttgtgccagaacaccatgcctggtgcttcttcctgcatgtggtagagatcgagttgcttaccaatcttacgatggtcgcgtttcgccgcctcttccaagcgttgcagataagcattcagttgcttcttatcaccccaagctgtgccatagatacgttgcagcattttatttttgctgtcgccacgccaataagcaccggaagttttctgcaatttaaagtgatggcagaaacgcatattcggtacgtgcggaccacggcacatatcaacgtattcttcatggtgatacaagcccggacgatcatcgcgactgatattctcatcaagaatagccactttataatcttcgccccgagcagcaaaagtatcacgggcttcttgccaactgacttttttcttgatcacgtcataatctttatcggcaagctcgtgcatccgcttttccagcagtgccaagtcttcctgcgtcagagtatgttcgatatcaacatcgtaataaaaaccgttgtcaataactggaccaatagccattttggtatctggccagagttgcttgatagcgtgtcccaacaaatgcgcgcaggaatggcgaagaatctccaaaccttcagcatctttggcggtgataatcgccaactgagcatcggactcaatcagatcactggcatccaccagctcaccattcacccgaccggcaatgcaggcttttgctaagccagggccgatatcaagagcaacatcaaggacagaaacagcatggtcataatgacgctgactgccatcaggaagggtaataacaggcattctaattccttatctgcagtggtgaccctcacgacagatcacatgcaagacataattattgtttgatttcaaaaagttaagtactcaactcaacccacatttgtcgaataggtactcaactgtgtacacaatttgaatttgtgacccagatcgcatcacaaaaagtggtagctatattatcactacttaatacaatgaggaacattatccctttttatcctgcataccggtttatcgctaacctgacgctagcataaaattaagatacagtaagcaatcaacgtgcctcatgatgcatcaatcaatgataatgatcagcgacaaagttatcattctccaatagctctataatcgccataatatcaacaccgtacaaccgaggggcaacaattgcagcgacaacctgtttcatcctccagaattctgtcgattggttatgatcctgataatcgcatgctggagatacaatttcgtgaacaagggacttatcagtatcttggtgtccctgaacgtgctcatcaaaactttatgtctgccgtttcgaaaggccgtttttttgatggtgtgataaaaggcaagtttttgtgccgcaaaattgggtagtacacaaccaggtattccataagtaactcaaactgaaacggtcgcttcaatgataaagattgcagagaagcctaccgtttcaggtattgggagaggattctccctctgaatagcgcaaaataagtataggtgtcatacacaataatgctgacggaaaacttattgtcgtaaatacgttaatttttgcgatagatcatgcctctgcaatcagaataatcccaccgtaggtagagccgcgataaatgcagcatcaaccgtatatggcatggtcagctttacctgtattttcaattctcttccaatagtcaattgaataagcatgttggttggcgtaaaccccatggcattacaacccaaagacgctataacatcgccctaattaagggctatcagttagcaaaatttatccgtgtggtgatgagtcactcaggtcaagccattgataaaaaatcatgtctacctcgtacgcctgacccagtacaccgtgtttatataagtttcgtaaatgtacataattcagccaaaaatgatttacattaccgcctattgcttttaagtagcgctgggtgtattgctatttctacaggatgtgcccataataaatttccgtttccgtgtagcaatggttactggaacgtcgccctgattgtttattcaatcggggcgttttattttctggctaaatgaatacgttttatcagatcgaacgccaaacagatttgagttttttattctgaggatattaaccttgcacagcatcagagtctttttctggctgcattctccgcgctgaaaaaccataattcagggagccgcttaggatagaagcgaatctcataactatctttgagtggggttaaacgccaacgagggcgagcttcccgtttcggttttaaaaaacgtagacgaccgcgaacgcgagcggcttgcatatccaacacccaagctacagaagctgataatggttggcgaacatattcatcttcaacgctaatatcacaaatgcacaaaatcctactcctcgaaaaaactgatgctgacataattattctggatagagggcgctgaaccaaccactgcccaccggacatttgatctgcatcacataactatgtgcttgtatgataatgtcggctacgatcaccaacactttccacaacctaacctaccgtgaataaggacaaaatagccttttacccaaagtatcgcgtacagtggcgaggttcgtaataatactcttcacacaagtaagttaagctggtgtatgaattattgcctgatatcgttttttttcgggtttgattgatgttatttgcggagtaggatccatgctaagtattttcgaattatttaaagccgttggcttaggattagtattgctgctgccattggcaaatccactgacgacggtggccttattgctagggttatccggtaatatgacccgcgaggagcgtaataatcagtcgttaatggcggcaatttatgtcttctttatcatgactatcgcgttttatgccggtcagatcgtcatgagtacatttggtatctctattcccggtctgcgtatagctggtggcttaattgtcgcgtttattggttttcgtatgctctttccgcaacaatcggctgaagatactcaactggaggcaaaatcccaggatttaaaaaaacgtaaatccatcaatattgcctttgtaccgctggcaatgccgagtactgcggggccaggtacgattgcaatgatcatcagttccgctgcaacaatgaaagaccagacaatgtttgcgccatgggtattggccatcgcccccgtaatcacattcttatgcgtttcgttgattttgtggggatctttactcagctcaggagcgattatgcgctgggttggtaaaagcggtattgaagcgatttcacgtttgatgggattcttgctggtatgtatgggtgtgcaatttattattaatggcgtcttagagttgatctcaacttatcaacctgtcatggcttaaatatcaagactcagtaaatataatttcaaagtaaaataaaaaagtaacttgccgtaaaatttaaagtaaacgctagccgatgctacaccatccataggctacatcggttagcgttttagcattactctgacatcgcccggtaagcggtatccaccttccacaagtaacgtggagcctgtgcagccgggtgcttcttttgtatatgctgataaaattcgtttgggctaagactattaattttattgactgccagacgtttatctgatgaaaaagtccgcaacatagcccccgcgccattcgcataagaaacgatggtggcataacgtaatgtctgcgggtcgttgatccccgctaactgctgattttgtagaatgttgatataagcagcaccaatatcaatattcttcactggatcttttagctcacgagagctcggttgaccatttcgccctttcatccggtacgcatcacgcccggcggtagaggctttaatctgcatcaagcctacggcattggatctactcacaacatccgggttgtaaccagattccacctggataatcgctttaatcagtgtttcatcaacgccgtaatggctcgcggcttgtttaatgacgtcgctataagcaacggtagttgaaccggcactgcttttcgctacgttaagagaattgccctgtggcgtttttttcagccacccgttattcgcttgtggtggtggggtttgtttagcacaccccgccaacaataaaattgccattaggcaaccgacttttgaattcacagtattccccgtgctgataagccgttttgtagcatatacaagttgtcactccgcccaaatagattttttggcctagtttgtccatattcaacataatgatcaggctatattaagtaactattggtaagttttagtttattgtataaggaggcttgacttcatcgctaatggtattgataatcattttcatttggaaaaagagaacatcgtgatgttaattaagaaaaaaagtccttatctcaaaatgatagaacgactaaactccccttttctacgggctgcagccttgtttacaattgtcgcattctcatcgctgatcagtaccgctgctttagcagaaaataatcccagcgatacagccaaaaaattcaaagttgtgactacattcacaatcattcaggatattgcacaaaatatcgccggtgatgttgccgtggtggagtcaataaccaagccaggcgcagagattcatgactatcaacctaccccacgagatattgtaaaagcacagtcagcagaccttatcttatggaatggcatgaatctggagcgttggtttgagaagttcttcgaaagtattaaagatgtcccgtctgccgtcgtgaccgcaggtattacacccctgcctatccgtgaaggcccctatagcggcattgccaacccacatgcctggatgtcgccatcaaatgcgctaatatatattgagaatatccgcaaagcgttagttgaacacgatcccgctcatgcagaaacctataaccgtaacgcgcaagcctatgctgaaaaaattaaggcgctagatgctccactgcgtgagcgtttatctcgtattcctgcggaacagcgttggttagtaaccagtgaaggggcatttagttatcttgccaaagactatggttttaaagaggtttacttatggccaatcaatgcagagcaacaaggtattccgcaacaagttagacacgtgattgatattattcgcgaaaataaaattccggtggtgtttagtgagagtactatttccgacaaacccgccaaacaagtgagtaaagaaaccggtgcacaatatggcggcgtgctatatgttgattctctgtcgggcgaaaaaggcccggtccccacttacatcagtttaattaacatgactgtagatactatcgctaaaggattcggtcaatgagccaccctgtttttgtccgccctgagctggtagtggataacgtcactgtcacttataacaatggtcatactgccatttatgacgccagtttttcactaacgggtgggacgatctgtgcactggtaggtgttaatggcagcggtaaatcgaccttatttaaaagcattatggggttagtcaagcccagtgtgggcaaagtggaactgagtcacaaacctatcagtcatgcactaaaacaaaatacgattgcttatgtaccacagacagaagatgtcgattggaacttccctgtgcttgtggaagatgtcgtgatgatgggccgttacggtaaaatgaattttctacgaattcccagtcgtgaagacaaagccattgtgaataaatccattgaacgagttgggttaacggcattgcgttcacggcaaattggtgaactgtctggtggccagaaaaaacgtgttttcttggcccgagcccttgcccaacaaggcacactcttactactggatgagccatttaccggcgttgacgtcaaaactgaaaatgccattattgagttactgcaatctctacgtgacgaaggccatctgattctggtttcaactcataacctaggcagcgtgccggaattttgtgatcacgtcatcctaattaatcagacggtgctggccgcgggcccaattgaaacgacatttacccagaaaaacctcgagatgacctttggcggggtattgcgccatatcaatctgtcggggacggcactgcatgatgataatgatccgcgcaccgtcaccgtaataactgatgatgaacgccccgcagtattttatggtcatactaaaaatgatccgcctgcacaaagccagtcaaaggagcaaaattcctgatgctggaacttttactgcaaccgtttaattataattatatggtcaaggccatttgggttagtgcgattgtgggggccgtttgtgcttttctatccgcttatctgatgctaaaaggctggtcgctgatgggtgatgcgttatcacactcagtcgtgcctggggttgcaggggcttatgctcttggctttccctatgccgctggcgctttctttacgggtatgcttgccgccttggcaatgacgctagtacgccacattacccgcctacgtgaagatgccattatcggttttatcttttctaccttttttgctgttgggcttttaatcgtttcactcaatcccacatcagtgaatgttcagtcgatcatcttcggcaatattctgggtattgctgatgaagatgtcttgcaggtagaaatcattattttggtttcttttgtgattttatgtttgatctggaaagatttattagcggtgtttttcgatgaaagccacgccatgtcaattggtttatccccactgcgcttaaaaatcttattctttacgctcctgagcgcctgtactgtcgccgctttacaaaccgtgggggccattttagtgatagctatggtcgtcactccaggggcaacagcctatttactgaccgatcgtttcggccgcttgctcattattgccattgctattggggccattaccagtgctttcggcgcgtatctcagtttttatctggatggggcaaccggtggcgttattgtcaccttacaaacactggtattcctgctggccttcttctttgcccccaaacacggattactggcaacccgataccgtacacggttgaaacgtcgtcatccgccggttcatcttccggaggataacctatgaatatgctgttcagtttgatcagtgagccattcgcctacccctttatgcagcgggcaattgtcgcggcaatcgtcactggtgtggtctgcgcgatactctcttgctacctggtactcaaagggtggtcgctaatgggagatgctatttctcatgctgtgctgccagggattgttctggctttttggctcggtatccctctggtcatcggcgcttttgtctcagggatattttgtgccgtggcaactggctatttaaaagaaaacagccgggttaaagaagataccgtcatggggattgttttttctggcatgttcgcgttcggcttagtgctgttctcccgtatagatactgaccagcacctcagccacattttgttcggtaacatgctggggatttcgctgacagaactgaaacagaccctgtggatcgcaggtttcacgctattggtggtgttactaaagcgcaaagactttatgttgtactgtttcgatccaaaccatgcgcgggttatcgggctacccgttaagtttctgcattacggtttactttgcttactggcattgactatcgtcgcgtcattgcaggcagttggcgttattctcgtcatcgccatgttgatagcgccgggtattatcgcctttatgatttgtcgtagttttgatcaaatgctggttgtcgcgacactggtttcagtggtcgcctgtgttttaggtacattaatcagttttcatattgatggtgcaacaggcccatgcatcgtgattattcaagctttattctttgttgtcgccctcatttacaaccatataaaaccgattaaagaccgaaaaatggcaccactcaccaaggcagtaaatccagaaaatacagccccaagtaacctgccatagcagtgacgtttctatttatatgcggtgctgtatgtctattatatagcccgcctattaccatcaacaaatggctgtcagcattaatgcctgcgtgttttctacagtgatattttgtcgtgataccgatataacgtatcaacaacgttattcgcctcttttttatttgatgccatttcatgcttatgtcggttttatactcgtgcagttttatctggcgcggttatccctgtgcgccagctcctatttttcgcatcataaagacgttaacctaacgatgtgactgatagcggataaggggtgaatcatgtggcaagcagtgaatcgtctgttaagtgaatgcctcggccccgccgagattcgggaaagaactgaattacccggtggggatattcatgaagcctggcgtctcagctacggggaaaaagaggttttcgttaagtgcaatacccgcgagatgctgccaatatttactgcggagtctgatcagctctcgttattagcccgcagtaaaacagtgcaagtccccgaagtgtatggggttggcagtgatcgtgattacagtttcctcttgcttgaatatatcccactaaaaccgttggatgcccacaatgcttattgtctagggcagcaattagcccatttgcaccaatggagcgagcaactccagttcgggctggattttgataatgatttagccaccaccccacaacctaatagctggcaacgtcgctgggcgcaattttttgcggaaaaacgtatcggttggcaactgcaactcgccgccgagaaagggatgtcatttggtgatattgatgacataaccaacgctgttcaggagcgcttgcaaagccaccagccacagccatcattgctacatggtgatttatggccagcaaactgtgctgccagcagcaatgggcctgttatttttgatcctgcgtgttactggggagatcgggaatgtgatctctctatgttgccactctaccccacattaccggcacaaatttatgatggttatcaaagcgtctggccactacctatcggttttattgagcgccaatctatttatcagctctattacttattgaaccgtagcaatctgtttggtggcaagcacctgatcaatgcgcaaaaagccgtcgataacttgttgcatcccgaacagttttcgctttaacggtaaactgggggttgctgccaaaaagttggcgccaaatacgctttgcaccacgctattttttccaacaataaatgaaaaaagccagcgcatcgcagtggtgttggctttgatgtcaaataaaccgcttatccctgaatcataatgccaagtaacttaatcacaaaatagccgagcacgccgataaccgatggcaggatatataacgtgaaaaactgcaaaaagatggtgtgatgcggcaatactatcttttcttctagttgctcacgactatggccttcattacctttggctcgctctaaaatcatctgatcttcaatgccctcccgaatatgtcgtacttgccgtgacatccgagcaccggaggcttgtaatgataggccgacaaaaatcaacatataaataatgaaaaacatgatatttcccgcggacaacccctgttctaaattagggactggcgagttataccaaaaaatattcaaaaaaggcgtattaaagcgcgccatgtcggtcataacatggataaaatccaacataaccgcattaacccctgtccctttttggctatacaaatagacaaaattgataattgagatcagtgttgacagcagcgctggaataaaaacgagccatcctgcaatccgtttgatgacggcgacgcgcccagcctgttgataggtcatgatttctccttgcaaaggttataacttatgtggcctggtctatctgctacatccacacgttgtgcggtactttaccgctatgtttgctatttatttactgtaaagtctattagttactgcaaaatctattagttactgcaaagtctattatttgtcgtcaaggctatgccttatcatcaagccaatcacttaacatcaagcctagctcatcagcatagttctattatattaatgaattaaattcgtactagtaattacttgtatgtatcttattgggcactgtgcatgccgtgctaaatataaacggtatcttaagccacgataaagagtcatgttcaacccgaacaaccgttatgaatcaatgataaagtgatcaactcataactaaacactgacaggagtgatgataaatggcgaccgctcatccaattaaagccgcaatttttgatatggacggcttgttgattgactctgagcctttatggctgcaggccgaactggatattttcaccgccctgggcttggatacatcctctcgagattccctgccagatactcttggcctgcgtatcgatttagtggttaagctttggtatcaaacaatgccttggcaggggccgagccaagaagaggtttgcaatcgtatcattgccagagcaattgatttagttgaagatacacggcctgttttacctggcgttgaatatgcattagcgctttgccgccaacaagggctgaaaattggtctggcgtcagcctccccgctacacatgcaggagcgggtgctcgcaatgctaggcgttgaaaagtacttcgattgcttggtttccgctgaatacctcccctacagcaagccgcatccagaagtttatctgaatgccgccgctcagcttgatgttgatccattacaatgtgtcacgctggaagattcagtaaacggtatgatagcgaccaaagcggcacgtatgcgctctattgtcatcccatcagttgagtaccgcgcagatccacgctgggcattggccgatattcaattggaatcattagatcaattgcgcaaggacgacatctcgtagtgtatgtatatgatatggaaataagcgtttttagtgacaaaggtaaatagtgacaaaggtaaatagcggcaaacgtaaatagcggcaaatgcggctttttagtaaaaaagtcgctatagcgatacggagtggaaaggatattgctgtcgtcagcggtaataaagggcggccagagtcagtgactcagccgccgaatatattttagagaaaatcatcccgtttaggcgtaaaagtatcaatcaagatgctgttgtcttccaacgatactgcaccgtgcatttcatttttcaccgcgcgatacgcatcccctgctttcaaaatacgtttttgcccttcaatctctacttcgaagctacctgctgcaacataagcaatctggtcatggatatcgtgtttatgagcgacaccaatagcccctttttcaaagtgaacacagaccatcatcagctcatcgctccaggtcatcactttgcgtttaatgccattgcctaacgcttcccaaggagtttcatcattgataaagaacattttcattatcttgcctcattttacagaataagtttctggtgtagcgcagtcacagttttacgctgaatcgggtgcattctacgggtaaaatccgtagggtgaccataattaatccaaaaatcatgacgtgcctcaaaaaataataaaacatcatttcatttttattgaattaacttcccgcaaacactatcatctctgcatcacaagaaacactcggtcaaaaatcagactcgtgtagatgccagcgcacaccatggcttcatacgcactttctgaccctatcgtggtttctggcctgggttatccccaccaagatacggttctacaagagaggcactgacatgcaagttcgtcaaagtattcatagcgaccacgctaagcaactcgacacagctggcctgcgccgtgaatttctgattgaaaagattttcgccgcagatgactacaccatgacctatagccacattgaccgcattatcgtcggtggcattttaccggtcagcaaagccgtcagcatcggtaatgaagtgggtaagcaactgggtgtcagttacttcctcgaacgccgtgaattaggtgcaatcaatattggtgggccaggtctgatagtggttgatgggcagacttatgacattggcaatgaagaagccttgtatgtcggtaaaggtgcgaaagaagtaaaatttagcagcatcgacagggctaatcctgccaagttctactacaacagtgcccctgctcacaccacttatccaaacaaaaaaatcaccctggcagaggcgtcaccacaaacgttaggtgatgatgccaccagtaaccgtcgcactatcaacaaatatattgtgcctgacgtgttacccacctgccaattgagcatgggtctgaccaaactggctccaggtagtctgtggaataccatgccatgtcatacccatgaacgccgtatggaagtgtatttttactttgatatggacgaagagactgccgtcttccatatgatgggacagcctcaggaaacgcgtcatttgctcgttcataacgaacaagcggtaatttcaccaagttggtctatccattctggcgtaggcaccaaacgttataccttcatctggggcatggtcggtgaaaaccaagtctttggtgatatggaccatatagctgttagcgaactgcgttaagtatcacctattaaagccacctttacggcggctttcacctccaataatgaaatcgcggtcatcgttgaccgccttgagagagattttagctatgattttagattcctttgaattgaaaggtaaagttgcgctggtgactggttgcgatactggcttaggccaaggcatggcgatcggtttagcagaagcgggttgcgatatcatcggcgtgaatattgtcgagccacgtgagactatcgaacaagtgactgcactgggccgtcgctttttcagcctgaccgctgacctgagcaacattgaatgcatcccttccctattagagcgtgctgtcgctgaatttggccatattgatattctggtcaacaacgcggggatcatccgccgtgaagatgccattaatttcagcgaaaaggactgggacgatgtcatgaacgttaacatcaagtctgtgttctttatgtcccaagcggttgctaaacagtttattaaacaaggtaatggcggcaaaattattaacgttgcctcgatgctgtcttaccaaggggggattcgtgtcccttcttatactgcctcgaaaagtgccgtcatgggcgtgacccgtctgttagccaacgaatgggcaaagcacggcatcaatgtcaacgcggtcgctccaggttatatggcaaccaataacacccagcagttgcgtaaagatgaagagcgtagcaaagagatccttgaccgtatcccggctggccgttggggcttacctgatgatctgaaaggcccagtagtcttcctggcctctaaagcatctgattatatcagcggttatactatcgccgttgatggcggttggttagcacgataaaccaccatctactatccacttatccactatcgcgattaatttgagttaacacgacttatctaccttattgtgacattcaactcaaaaacgcatcaggcacaactttggttgtgcctttttttattatttatttatcaattagttaacaaataaaattttcggtttttttcttataaaaccaccaaaataaaaaatcaaaacaacgttccgacttcgatcacacttttgtcattcatccaatgactcgccagtaaatacaaatataatagattgaaacgatgtttctatttataaggaacctaaagccggttccgtcctgacgtttcgaaggtggggttacgacgatgggttttacaggcaacattaaaggcagcgacgcaatgatgattaactggctcagcgctatccgcagctatgttgatttagtccagtctgttggtcacagtcagcttaatccatccccattgctagccgatggttttgatgtattgactcaccaacctgttgtttgggaattccctgacggccaccatactccgatatctaacttcgccagccagcaaaactggttacggacattggatgccctcagcttggtgactcaggatccgcaatatcaccagcaagcccgggtacaaagcggctattttatgcagcatggtgtccataacgaaagtgggcttttttactggggtgggcatcgtttcctcaatctggataccctaaaaactgaagggccagcctcaaaagaccaggtacatgagctaaaacatcatctgccctattacgatctactggtaaccattgatcgggagaggacccttaatttcttacaaggattttggcacgctcacgtagaagattggcaaaccctggatctgggccgccatggcaattacagcaagcaacgtgacccacaggtttttacccatcctcgatatgatgtggttaacccagcagagttaccaaaactgcctgaaaccaaaggactcacctttgttaacgcgggcactgacttaatttacgcagcctataaatatgctgaatataccggcgatgctgcggctgcggcatggggaaaacatctgtaccgccagtatgttttagcgcgtaatcctgaaacaggtttaccggtctatcagttcagttcaccacaacaacgccagccaatacccgctgacgataaccagactcaatcttggtatggcgaccgtgccaagcgccaatttggcccagagtttggtgaaattgcccgtgaagccaatgtgttgttccgcgatatgcgcccattgttgatagacaatccactcgccatgctggatatcttgcgccagcagcctgatgcagaggtcttgcagtgggtgattgatggtctcaagaattactatcgctttgcttatgatgtcgagagcaatacattgcgcccattatggaacgatggccaagatatgagtggctacgtcttaccgcgtgatggctattatggcgtcaagggcactgttatctcaccattcccattagacgtcgattatttgttaccgctggtacgtgcctggcggttaagtgaagatgaagagttactggatttaattggcgtgttattgctccgctggcaattagctgagctgaataaaacacagcggcgcgcaacactgatggccgctcaacgccctattgcctctccctacctgctactggctctagtcgaactggctgagcattgtcaatgccctacattgtttaccttggcatggcaaataggtgatgacctctttaaacgacattaccaccgcggactgtttgtagaatcggctcagcaccgctatttccgtatcgacaatccgattgcattagcattattaaccttgattgccgctaaacaagataagttagcagcaatacctcaatttattactaacggtggttatatccatggagattatcgggtaaatggggaaagccgaactctgtatgacatcgattttatttatccgacacttttgaatcagtagttttatttatctttcattttattaaaaataggtaagcattatgaatgaaaacagaatgctggggttagcctatatatcaccttatataatagggttgataatattcacggctttcccctttgtatcatctttctttctcagttttactgagtatgacttaatgagccctcccgtctataacgggatcgagaattatcgttatatgctgacggaagatgacttattctggaaatccatgggcgtgactttcgcttatgtgtttctgactattccattaaaattggcttttgctctagggatcgcttttgtactgaactttaaattacggggtatcggtttcttccgtaccgcattctatatcccatcaatcctcggcagcagcgtagcgattgccgtattatggcgcgcgttattcgcgattgatggtttgcttaatagctttattggtgtctttgggtttgaggctatcaactggctgggagagccatcactcgcgttgacctccgtcacattactgcgtgtgtggcagttcggttctgccatggttatcttcttggccgcgttgcagaacgtaccacagtcacaatatgaagcagccatgattgatggtgcctctaaatggcaaatgtttatgaaagtcaccgtgccactgattacgccggttattttctttaactttattatgcaaactacgcaggccttccaagaatttactgcaccttatgtcattaccggtggtgggccaacccattacacctatttattctcactctatatctacgatacagcgtttaaatattttgatatgggatacggcgctgcattagcctgggtgttattcctggtcgtcgccctctttgcctcaattgcatttaaatcatctaaatattgggtcttctactccgccgataaaggaggaaaaaatgactgacgtacaacaaacttccaaccagaaaaaatcagatctggctcaggatattgctgatgcggaaattagccgcacattacgcaaagctaaagtcagtgctgctttccgctatatcgttttgattattgtcggtctgttaatgctttatccgctgttgtggatgttctcagcagcatttaagcctaataatgaaattttcactacattaggattatggccagagcacccgacaagtgatggtttcattaacggctggaaaaccggtactgaatataatttcggtcattacatgctgaacacctttaagtatgttattccgaaagtgatcctgaccattatctcttccaccattgtcgcttatggctttgcgcgctttgagatcccttggaagaaattctggtttaccaccttgatcaccaccatgttgctgccaagtaccgtgttgttgatcccgcaatacatcatgttccgtgaaatgggcatgctgaatagctacttaccgctctatctgccgctggccttcgccacacaagggttcttcgttttcatgctgatccagttcttgcgcggtgtcccgcgtgatatggaagaagcagcacaaattgacggctgtaactctttccaggtgttgtggtatgtggtagtgccaattttaaaaccggccattatctctgtcgccctgttccagttcatgtggtcaatgaacgactttatcggcccactgatttatgtctatagcgtagataagtacccgatagcgctagctctgaagatgtcaattgacgttaccgaaggcgcaccgtggaacgaaattctggcaatggcaagcatctccattctgccgtccatcattgttttcttcctggctcaacgctacttcgtgcaaggcgtaaccagcagcggaattaaaggttaatagaggatttatcatggctgaagtcattttcaataaattaggtaaagtttactccaacggtttccgcgcggtacatggcattgacctgaagattaatgatggcgaatttatggttatcgttggtccatctggctgtgctaaatccacgaccctgcgtatgttggccggtcttgaaacgatcagtgatggtgaggtccgtattggtgaccgggtggtcaataatttagcgccaaaatcacgtggcattgccatggtgttccagaactatgcgttatatccgcatatgacagtaaaagagaatctggcctttgggttgaagttaagcaaattacccaaagatcaaattgaggctcaagttgctgaagccgccaaaattctggaattagaagatcttctggaccgcttaccccgccagttgtccggtggtcaggcacagcgtgttgctgtgggccgtgccattgtaaaaaaaccagatgtgttcttgttcgatgagccactatcaaacttggatgccaaactgcgcgcctccatgcgtattcgcatctctgatttgcataaacaattgaaaaaaagcggtaaagcagcaaccaccgtttacgtaacccatgaccagacagaagccatgactatgggcgaccgtatctgtgtgatgaagctgggccacattatgcaagtggacacccccgacaatctctatcactaccctaccaatatgtttgttgccggttttatcggcgcgccggaaatgaatatcaaaccgagcacgctggtagaaaaagaggggcaaattggcctgacagttggtcaatacaccctggtattgaatgaaagacagcaggccaaagttgccacccacacaggagaaaaagtgttctttggcgtacgtcctgaatttattagcatgtctctgcaaccgtttgtcggtaatcactcacaaggtgaactggttcgggtagaaaacatgggccatgaattctttatgtatatcaaggttgaaaactttgaattgacctgccgtctgccgtctgacgaagcacgaccgattattgaaaacggcctgcatcgcaccgtgtacttccagtttgatatggataaatgccatatctttgatgcaaaaacagaaaaaaatatctctctttaacaggagcagtacccaatgaaaaaagcgatcctacacacgctaatagcatccactctggctctattgtcacatcaagcttttgcagcacaggacgacgtcaatttacggatgtcatggtggggagggaacggccgccaccaggtaacattgaaagctctggaagaattccataaacaacatccgaatattaatgttaaagcggaatataccggttgggatggccatttatctcgtttgactacacagattgcaggcggtactgaacctgatgtcatgcagactaactggaactggctgcctattttttctaaagacggaacaggattcttcgatttaaataacgtaaaagaacaactggatttggcgcaattcgatccaatcgaactgcaacagactaccgttaatggcaaactgaatggtattccgatctctgttactgcacgtatattctatttcaatgatgcgacctgggctaaagcaggtttagaatatccaaagacatgggatgagttactcaacgcaggccaagtatttaaagaaaaattgggtgaccaatattaccctgttgtattagagcatcaagatactttagcgttaatccgttcttatatgacacagaaatacaatattcctaccgttgatgaagcaaataagaaatttgcctacacaccagagcagtgggttgagttctttaccatgtacaaaaagatggtagatagccatgttatgccatcttccaaatactatgcttcattcggtaagagtaatatgtacgaaatgaagccgtggattaatggtgagtgggcaggaacttatatgtggaactcaaccattactaaatactctgataacctgaccaaacctgcaaagttagatctgggcccatatccaatgttgcctgatgcaaaagatgctggcttattctttaaacctgcacaaatgctctcaattggtaaatcaactaagcatcctaaagaaagtgcgatgctaattaacttcctgctaaacagcaaagaaggtgttgatgcattaggccttgaacgcggtgtaccgctgagcgcagcagctgtagcccaattgcgtgccaatggtgtgattaaagatgaagatccttctgttgccggtttgaatatggcattggaattaccacatgaaatgaagacctcaccgtacttcgatgatccacaaattgtttcactgttcggtgatgcaattcaatatatagactatggtcagaaaagcgtagaagaaacagcagaatactttaataagcaaggtgatcgtattcttaaacgcgcaatgcgttaattaatctaattatttaacttaagtcacaaaataaccctgccatttatttggtggggttattttgtttaatcaaataaaaataacccgccaactagatcggtatcacaaaataatatcgaaattataaattagttactaagaaagatcttgatcacacaattaattaaaaatacaaatagaatgtatgacaacaataaatgaaacattgtttctttttttgtggttgcgcgttttgttcatatgttgatttttatagttttgttgttttgaataaccataactctgggattatataaaaatgaaattaaaattaattactctggcagtggcagcagcagcagtatccgttatcagttttagttccgttgcaacaacgattgactatcgacatgaaatgaaagacaccagtaaatccgatcacaaagaccgtttactgatctcaaaccgttttgcgaatggttttggtttgtccttggaaggtaagtggggccagcacagctctgataccacgccaaataagccattcaatgagcaggtcagtaatgggaccgaaatggtggccagttatgtttataaattcaataacaccttccagatcgaacctggtttctcattagactctacttcagattccaacaactaccgtccatatatccgtggaaaagtggctttcactgatgatttctcaacgtcactgcgctaccgtccatactacaaacgtaatcaacctgctcagactaaatcgactgagaaaggacatgagttcaccatgttatttgcttataacttcttgaaagactattcagctgaatacgaattaaactacaagaagtctgaagacgaaattctggctaataaagaaaaatacgaatgggcacatgatgtaaaaatcgcctacaaatgggataaaaactggaaaccctatatggctattggtaatgtcccaggcagtaaagtgactgacgaacgccaaactcgttaccgcgtaggtatccaatacagtttctaaatatcgtgtcgttatgagtaccctcatcattatttgttaagttatgcccattctctgcattattttggggaaaagttgactcccagtcacttttccctttttttagcttagcgatttatgtcccccctctcgtcagccgttatacatttatagttgttattgcatttatagtcgttattgcatttatagccgtcattcatttgcagcctgaatacattggtcgtcggtatacctctacgtcttatacctctatgtgatgcagccaccggccattagaccagggaatacctcggtattgagccaattaccctaatccgcaccatcctgtagggatccatcctaaatgctcaaaggttatccaccttttatctctgtcaggtaaaaataagacatttagttacaacgtaacgactgttcacgccaagaaaaatctcatatactggataaatcaacagctacaaattcggaatttaagtatgacaggggaaggacaccttattttttctgttgcctgcgttattttagccaaaaaagtcggtctcacgccggaactggcacatggcgattggtggcatattattcccggcgccctgctgacctctctgctgccagatattgatcacccaaagtcaatcctcggccagcggttaaagtgggtttctgtgcctattgcccgcgtatttggtcaccgcggatttacccatagcttattggcggtgattgctggcattgcactgtttcaggtagatgcaccattgaatggggtgctccccccagatgtatttcatgccatgataataggttatttcagccatctattggccgatatgattacgccagccggtgtgccgctattgtggccctgccgctggcgtttcagtattccgctattgcggccacaaaaaggtaatcaattagaacgcgtattatgtgttctgttagtttgtttttccgtctactggcaaactgacaccaccatcccgttgctctactatatggaacaattgaaaagctttaggttatgaatacatcaagccgtatgaataacattcaaattgatttgatttaatacaaatcaatactaaaacttatatagaattctttttggatataagtgagctaactcagtaactgctaccatatacggctagctgtaccaccgtcgtgcatcgtacttggctgtataaaataaaatgcgtcaatataataatattttggagatttggggatgaatttaccacttgtggttaatgtgctggtatttgcaacactgctattgctcttagcacaaactcggcataaacagtggagtttggctaaaaaagtattgatcggcttagtactgggtgtgctgtttggttcagggctgcaatgggtctatggcgcagataatccaatactgaaagagtctattacttggtttaatattattggcaacggctatgtgcaactcttgcaaatgattgttatgccgctggtattcgcctcaattttgagcgcggtagctaaactgcacaatgcgtcatctctgggtaaaatcagtattttgaccattggtactttgctctttacgacattaattgccgccttggttggtgtattcgtgaccaacttatttggtctgacggccgaggggttgatacaaggtactcaggaaacagcccgtctaagcgcaattgagagtaattatctaggcaaagtagccgacctgactgtgccacagctgatcttgtcatttattcccaaaaatccgtttgccgatttaacgggtgccagcccaacgtcaatcatcagtattgtaatattcgcaaccttcctcggtatcgcggcgctacaactgttaaaagatgatgtcacgaagggccaacgtgtactggcagcgattgatacgctgcaagcttgggtgatgaagttagttcgattagtgatgaagttgaccccatacggtgtattggcactgatgaccaaagtggttgccggttctaatattcaggacattatgaaactgggcagctttgttgtggcatcgtatctgggcttggccatcatgtttgttgtccatgcggtgttgctgtcgctcacgggtatcaatccgctgaaattctttaaaaaagtgtggccggtactgacttttgcgtttaccagccgctccagtgccgccagtattccattaaatgttgaagcgcaaacccgccgtctgggtgtcccagaatctatcgctagcttctcagcgtcttttggagcaactattgggcaaaatggctgtgcgggcctgtatccagcgatgttggcggtcatggtggcaccaacggttggtattaacccgttggatccggtatggattgctactctggtcgggattgttactatcagttctgcgggtgttgccggtgtgggtggcggtgcaaccttcgccgccctaattgtactgcccgcattgggcttgccggtgacattggttgcgttacttatctccgttgagccattgattgatatgggccgtacggcattgaacgtcaatggctcaatgactgccgggacgatcaccagccaattaatgaagcaaacagataaaaacattttgaataatgaagatgacgacgttctgactcaccagtaaacgctaatttggccattattaagaccgtcagatcaagctagtcactttttagcccccaaccgtgggataccccacgagtgagtcgctttatttttgactggcttttttgtttctgtaaactgcccttcaccacgctgtgttagctatttgagtagacgaattatttactcaaatcagtgattcggatgagtggacacaactccccccggcagcctcaagtgctaagggtacgatatttttcaactaatgctaatgcaatggcttcagtttcaacatcaggcacaccactgaaatcctgaggccggaaatgcatctggaacgctttgatcacttggcgagtttcagtatccaactggccattctgggggattttgtagccataagccgctaatgcctgctgaatgacggctactgaagcagcgcccttcttatctcttccaccaatatattttgccactgtcgcatcatctggccaggcacctacgcccttctcggccaagcgcttccatgggaataatgggccgggatcagattttctcagtggagcaatatcactgtgggccacaacatcagacggagaaatattgtaacgttgtacaatgtctttggtgagctgctctatcaattcaatctgtgattcgttgtagggataccaggttcttcctagcatcttttccgtgaagcctaggttgacgatttcgataccaatcgaggtgtcgttgaggttgttacgcccctgccaagagctgacacccgcatgccaggctctctgcgcctctggcactaattgcaaagcaatggcttttccaccagctttctttgggtgagtagggattaaataatgggcactcacctcaccctgagtgagcaatcttagtgactcggcgtcatcgactgcggtgtaatgaaggactaaaaaccgtacccgctcattttttgcaacagagggataatgggtatcaatttgatatgcgccacggtcgatcaactcattcgagctgcgatgatctgaactactgcagccggccagcaacaataatagccccccactcaatagcttcctcattatttatctccctataatttaattaatcgcggttatcatgacctaaaaaaattaaacaaattataaacaatacttatcaataatcagtaaaaaggccaaataaggcttattacctatgatagtgccaagtcagtaatcatacgcgcagtaattattaaggtggatagcaatattaaggtggatagtaatattaaggggaatggtcattattaagaaacataatatccatgcgaacagtatgattattcatgtgatgaaaaacagcccctgccagaggagctgtttttataaaaagagataaatagtgataattaacagctaactaaagttatccaataacgataaagtacttaccctatttatcgacacttttatcagaaaggataatcgcggtaacccatttgctcagaaatattgcgggctgcgcaatgtaacgatttaacgtaatcactctttctgtcttcagcgaaacgtagtgtcgggaaagaaatacttaatccggcaatcaccacaccaaaacggtcaaagacaggaactgcgatacaacgcaaaccttcttcctgttcttcaatatcctcaccaaacccttgctcacgtaccttatctaaaaccggtaacagtgcagcagtgctatccaacgtatatttggtgctgcgggtaaattcgatatgagacagaatttcttctacttcaccacgatcacgccaggctaatagcaccttcccaatggcagtactgtgtaatgggttgcggcggccaatgcgggaatgcattcgcaggttatacatcgagtcaattttatgaatatacacaatgctatcttcatccaatgcacccaagtgaatagtttcacgagtttcattagataattcacgcatctgaatatcagcactgcgaatcaaatcgacattttgcagcgctttcgcacccaattcaaatagcttcagggtgagggaatatttctccgattcaccttcctgtgccacataacccaaggacttcatggtttggagaaaacgataaactgtactcttaggcatcatgactcgctgagaaagctcggtaatacctatttcccgttcttcacccaacgcttgtaatatgccaaaaaccttcagcaccgacgagacagagtcgggctgtttatctagatctgcaatagccattttttagttaccctactcagttttctttgattcataaaacaatatgttttagaaaaaatagaacaatggttttattataaagggaagttgcgagactgtgcaataaaccaatgtgaataatcggataaaagccttgcagacagcaaattagcctctttctaagagagaggctaatggaaaactcggctattgccaaacagactcaggcaatgtcaccatatataatgcgggcttgccgtggacgtctgacgtaaacaggacctgcttatcatcaggcgtaaaagaaggatgaggatgcgtaacctggcgatcaccttcaaatacctgccatgatgtatcatgtcgagcaatacgatgctgtgtcccattctttatattgaagacatacaagaaaggatcattttcgatcttataaccgctgttatcttgcacatcaaccggtgcgtcagacccatcacctaccatcagtgtgccatcataattactcattaaatgtgagcaggcaggcatagaagtcaattgacgatttttcaatgtcactggatcagcactataaataaaacgatcggaactgcctttcaaataagagacataaaccaatgctgaaccatctggaacccagaattcatgcgtacagctctcaccttctgcatgggttttcactttacgcatattgctgccatcttcattgatgagccacatacgtgcatcaaccagatcgtgtggcccttcatggcagaacgccacggtgctatcgtcataagggcgataaatagggtgaccaagccactgattttcttgcaggataaccgctgattcgccagttttcaaatcaacgcgcatcaggcggcaacacggtttggtgaaataaaattcgtggaatttcttccaatctgtcaacggttgccagtcttcccgcttaatctcaataccgaccaatttagtacaatcagaatttgctacccacgttccataaccgacccactcttctggcacctgataaaccacgttctcttctaatgtggcgagatcaacacgcatcaaattacggccatccttcacgtagaacagcgcatcatcttctggtgagaggaaacccccaaaggtattatcaccgcgcccttcagtcagttgtgttgcgacccggctgttaagatccagtaaatagtaattccatgggccatcaaaagcaccaccgaacaacagtttactaccatcacgggtgaaacatttctgatagaaatagttacggtgacaagtgacatcagggggcgtcagtcgggtcacttgtgcgccggtagaggcatcctgataagtgtgatatgtcagggggatttgtttaccttttgccatccggaaaatccttaaaatcgtcagagaattaaaatttactcgcaggagaacctgtcgactaatactatctcacattatagaaacaatgtttcatttttccgtgatcgcggttctactttttctttttatcgtaaattactctttttatcgggcggttaatctggtgcaagatgtgcaattaaccattacacttatgattaactcaatgaacttatgattaactcaatgaacctatgattaacgccatgaacctacgattaatcctatatacttacaattaatctgatgtgtaaggatgcaatcaggggcaataatcgttagcatatcaatactcacctattttattacttttacagatacgcacctatgaacccatcaacaagtgatggcttacctgtacctcaacgctatgccgcgatactggttattgctttaggtattatgatggcggtattggacggcactattgccaacgtggcattaccgactatcgcacgtgacctcaataccagcccagcgacatctatctgggttgtcaatgcttatcagctcgccatcaccatctcactgctttccatggcgtcattgggcgatatcattggttaccggcgggtttatcaagctggcttactgatattcagcgtgacctcactgttttgtgctctgtccgattcgttatggaccctgacgtttgcccgtgtgctacaagggtttggcgcggcggcattgatgagcgtcaataccgccctgattcgtatcatttatcctcgagcccaacttggtcgaggtattggtatcaataccttgattgttgctgtgtcttcagccgcggggcccagtattgccgctgccgtgttgtctgtcgcctcttggcaatggctgttcgccctcaacgtgccaattgggctattagcgtggtgtttaggtataaaattcctacccgccaataatacgaaaagcaacggcaatcgctttgatatcaccagttgtgttctgaatgcgctgacatttggcttattgatcatcgcaatcagtggtttttcccaagggcaaagcccggcagtgattgctgctcaagtggttgccctattactgattggtttcttctttgtgcgtcgtcaactcacgcaatccttcccactgctccccgtggatttactgcgtattcctattttcgcgttgtcgattggcacttcaattttttcttttgccgctcaaatgctggcaatggtgtcgcttcccttctttttacagaccgtattgggccgcgacgaagtggcaaccgggctactgttgactccatggccgttggccaccatggtcattgctccgatcgcggggcgtttggttgagcgctatcatgcaggtttattaggtgggattggtctggctgtttttgccagtggtctattcttgctggcggtgttacccgccaaccccagcgacgtagatattatctggcggatgatactgtgtggcgcgggttttgggctgttccagaccccaaataatcatacgatcatttctgccgctccacagcatcgtagcggcggagccagtggcatgttggggaccgcccgcttgctaggacagacctcaggtgctgccttggttgcgctaatgttcaatatgttctcaaccaacggcacccacgcctccttgatactggctggctgttttgccagtatcgcggcactggtgagtctcttacgtgtaacacaaaaaagtcattaggctcttgggggaagcctgaatattggcttccccccggcaagacgatcactgatttattgtagtggctgctgcccttcaatgggtgagccaaaatcatcaataatggtgaaaaacacactcatattcttcgccagcgcgttgttgcccactggggcactgtccacgctgctttttggtcccaccatatcatcagcgcccagtttgatagtgacgccctgcgcggtatgaccttgggcgatagccaatgtctggaatgtgacattgaatggcgtcggattagccacgcgtaatacacggccctcccctttaggtaccagagtgaaagacaacttagttgctacaccttctgaactgatcggtattcctgccgggcggtaaaataatttaatacgtgagcgaaaagcgatttgtaccgcattttgtgatgattgatttgcagacgctttgggcggcacttccaacacattaagccaaaacatagattcacggtcagacggcaactgattagcgcctccggtataataaatacggatagatttattggtcttggcgttaaggcggaataccgggctatcaaccacaaacgggacgtttatctgctcaatgggcttatccatttcagcgatattattatccacccagagttgcagcaacgctggatgaaggccgtcattgaggatctgcacactgccggatttatcagcaccggtcactatcacccgtgtcagaccaatcgccacaccggcttgaaccgtagcactcaacaccaaactgcttaaaatagccgtaatcagtaaagtacgcagattattcaccttacgggcacgcggcctgaggattagccataacgttttcatttatagatcaacgtaaatgtgaactcaccttttactgaaccaggtgtcacggtgttttctatttggtaaattcccgcctgcatggggaccgtgtaactttgtgtgctactggtgtcataaccactcatcgtgtattccttatccaattcaatcgccgcatctgattggctgcgcagtaatacccccaccccctcagcagtcgagttggcatccaacgcaacaacaccattagccgaatccagaatactcgtcgtcgcaccaaatttataattaataccgtctagtccacctgggcaatgattaaaattcagattaaaagctttaagtgctttcaccgtaccaatgccggtaaactgccgcgaattgacctcaggtagattcacgaccacatcaggcgtggtacaggtttgcgtcattatctgaatatcaatgctatttgccgggacctgaacaatcctgtagcgagcaccactattatccggcacaccatcaatggagcgccgatggtaaagataagcaaaatcaaatatccttacgccacccgatcttagctcctcactcgccttcacatagtgaatttgcatttccattcctaagggaaatttaatcccatcattataaggaatcggtcctattaatggggcactcaccgtgccgtctacgagcccaaaaccctctagttgggtccaatcgctgctaaaaccggccccgatagcacgaaaacgtacggcaattcccaagccaggattagtatcgccagtgcggaaaactttgtaattaccaccatcaatattggtcgtaagcaatggattataaggtgaaaataccaaaatcccagcccgcacatcccgggactggtaagcgggtaatagcgcgcatgaccaaacttcaggtgcactgatggtcatccatgaaccaataggatcacctatggccgcattaggcttaacacgaataatactggtagggggattgatataaatactgccagtatagtcacaatttatcccgaggccttcagcccacactttactgcttggccccccagccacaacgaccaatatcagtagcgtagcaacagaacggacatgagcataaacgcgcaggtacatgttgatatgccgaatcactgttttcaccctatagaaataagcactcatttgcatatcacctctaagcgccggtagtcacctttgactagatgaccttttactaggttaccttccggcaatttatagtcaaaactgcaactctcaccgatgccatcaccccatatcacgcgcagattaccggcttgttgattcactcggaccattgcctgaccgccctgagcaataaagccgacgcgggtccctccgccatcttttacttccgccccaaacggcaagggggtgttatctgccagatgccccctgactaaaaccgaataaccggttgaggtctcgaatgttaccaatgcaacagcacctgcggttggcgcaactttttggctagtacttttaaactcaacatctgcagatagccctttcggatctaattcaacctcattctgccgatacggacttaaataaggcaatatcgcacgcccacgacgatcaagatacatactggagtagctgccgactcgcgctcccgcagcatctggagcctcaataataccgacggtatcacccagtgcaggggccaatatcaccccaccacgataagccactaccccccctgacaagctggcactggcttgatcatagctgttactcttcgaataactaccgcccaccgtggcgtaaggtgcctgccaactgccattcgcacctagggtgttataactgccattttcatcgctacggttattcgctgcagatacgccatagctaaattgattatcctcacccgcagagccggaaaccccggtttgtattgcactgctaccacgagtattggaataactggagctcaaacgtggtgcaccagcctgtgtccccagaggaatcgaaagggaaacacttaattggttgtcccaatcgccgctaggtatatcacgcaagcgattaagcgccacgttataactcagcgacttatagctattcgtgtagccgaattgaaaattcatatcgcggttacgcccatcccagtaatcctgcacattggcatttgcgtagaacgagccatagccatcaggtaagccctgagcgatactcacttgcgcctgattgcggcgacgatacttaaaactatcatcgtagcgatcactgccattcggccaacttgaatcaatctgcgtattattgacttcaccatgctgtaaataatcacgcattcgcatagcttctgctggtgtataaaaaccgttactggaatagtgataactggcgatggtcaagttggtattggtttccggcaaggatttggcataggtcataccaatactttgcccacgttgattatctttattaggcagacgggtttgtgcttgcgtcacattaaatgccactgcaccaactggtgtgttaaatgccagcccggcagaggctgataaatagccttcagccgcaaccatcccgccgttaccggtgagtaaattggataacccatgacgcaccgttcccataaagagaaccggtttatctaccatcgaattgtcacgatactcaccggccatcaatgagtaacgcgtggttcccggtcgcagcaactccgctatcgaggcaaaaggaacgataaatgtctgttcgctgccatccgcttcggtaatggtgacattgagattgcccccctgaccggtcgggtagaggtcgtcaatgacaaaaggccctgggggtaccgtcgtttcataaataggccgcccctgttgacgcaccacgacgcgggcgttcgttcgagcaacaccccgtaccactggcgcataaccccgctgagaatccgcatacatccggtcatctgaggtcaactcaatgccgcgatagctaaggctgtcgaacacctgaccatccgtgtttgaatcaccaatagtcattttgctgtatagcgagggaacggcccgttcaacataagtggccaggttctgataatcaaagccttggctatcacttcgattcaatgcactgcggtaatatagacgccagctttgccagttaagcccgcccaagagccccagatattgataagtctggctaccgatatcattctggttactgcggtaaccggtatagtcatatttcaaggtggccgctgtcacgccatcatcccaatatttaggatgcacataaccgcgagcctggcggatcagataagcttgaggaacctgaatatccaagcgttgctgattgtcgtcaaaaatagcatttccaccttccagcaaacgactcaacggagagcatgccccgcgactttcgagcaatttcacggtatcggaagataacttcgccgtatcaacccccaactcatcaaagagttttacgtcaaaacagggggtggcaactttcgattctggcgacggcaaggcaaaacgcatttcctgacgaccaatccattgatcatttaaatagatatcaacctgacgctcaccgggggaaacaggattaccctcactgtagcgggtggcatcaacgggaaaacggaggaaggcgtcactaaattcaacgtattcagaattctcggcggcagatgacggaatatataacatgccaccaataccacaaatagcgaaagagaatgccggtaaatattttaggcactcgtttttttgaaaaaatatgaaagcactaagcattatatcgaggccattaaattaaatgcagtatataaaagtgcaaaaaatacaaattacccttaatttgtattttttatagttttattgggtcagtttttgcgtaccttgagtttcgccgccctgatcattaataacagaataaaaaacttgtgccgaattattgatcgatgcttttgcactcgtaggtaagcttagttcactaaaaggggcaaccattttattattgattttagtaaaattagccaatacaggccctttctctgacgtgcgtaattctagctttctcaaggtaatgtaatacggtgaggcattctttatgacgatctgattgcctttcattgaaaatgcgagactcttggccgcttgcgcaggtaatacggttaatccttcagggcggtaaaacattttaattctggtacggaaagccaattgcattttgttctcaccaccagccgcactttggattggctttggcgggacttctaataagttaaaccaaaatagggtttcacgatcagccgctaatccaccatcagtgcgaaaaagacgaatagtctgatcccttttagggtctaaacgtactactgggggggttacactaaacggcaccttgatagcctctgggcgtgcgttcgcatcacctttatctatccaggcctgaagcaggaccggcatatcgcccgtattggaaacctttaccaccccctcacgttgtttctcttcataaataacacgtgtcccactgatcatcacttcagcacgagccacagtcgccacaaccgataatattaagagtgtcagtgtcgttaagagtcgcactgtccttaaaaaggacaatatagtaaggagcgttctgcgcatatgggttccaatgatgtcgaacttataaagctgggagcactaagctcccattttatgccggattggacttgctatccgcgttagttaatcatgaacaagtgttaatcataaataagcattaatcatgaacaagtattaatcataaacaagcattaatcataaacaagcattaatcataaacaagcattaatcataaacaagcattaatcataaacaagcattaatcataaacaagcattaatcataaacgatagtatagtcgacattcgtcgcgaccaaacctgcttcgacattcgcttcatttgcataatattgtgcataatagcttaatgtcgcgccatcaccagaaatatcttctacgacattaccttggttgccagaacccaccacaataggtgcactatttttgtctaatagacgaacctgtacgccggttgcaccatcgatgtcactgttattcaaacgaccagtagacgcttctacggtagtaccctgttcaaaatgagcataggcattacccattgtcgccccagtacaaccggttaatacgatattgaaaggtgtggtacccgctacagaattaatgccgtctaatgcgcttgcagagacaactggcaatgtgacggtgccatctttagtgccattattaacagagataccacacgtcgtgtcagtaattttaccgttaatagtaatagtaccatcggctgcaaatgctgattgggcaataaataagccagcgaaagctgcaattaacacattgcttgatttaattttcacgtttatttcctgtatttaatagcaaggttttatattaataaactgagcggaattaatataatcagttagtgtggttcgatttcgattaatctattattacagcatttagataattgtcaatttgaccaaaattagacaattgtcaattcatcataaaatgttaagaatgatcagaagtgcaataaagaaaaacggaattgctttgtatgaattatcccaatttacgtaagaaaattcctacaaaacattttttattaaaaaaataataatatgaaggtctattggagtcaaaaaataattggcgaataaaaatcaataaaaacagcagcatgagatttttcttatgttagcattagaatgaaaagacaaaaaaattcatttttcaatgaagtaagtcacagatttttttaatgaaattagcgacagaaacatttttacacattatttacttaactaaggtgaaaaaaaatttttatttaggaaaattactgtaattcatgctatccacctatcaaatctaggcgtttggcattatggccacggtaaaaaaacaccctgtcagcttaccgctcacagggtgtgaagaccatattatcatttcgcgaatagaaacctcttatttcgctctattaatttctattacctcaaatactgatattacttcagatactgaccagaacgtaatgcctctatacgtttatctaaaggcgggtgtgacataaacaattcactaaacgttttagatttaccattaatacagaaagccatcatgctacccgcttcctgcggttcatagctggttttcagccgttgtaatgccgcaatcattttttcacgcccaaccaattttgcggaaccggcatctgcatggaactcacgatggcgtgaaaaccacatggtaataatactggcaagaatgccgaacactaattctagtaccattgatacggcaaaatagaccattggattaccggggctgttactttcaccgtctcggtcacctgataagaaaccagcggcaatttgtgcaatcagtcgtgaaataaagatcacgaacgtattcacgaccccttgaatcaaagtcatggttaccatatcaccattagccacatgactgatttcatgggcaatcacggcttcagcctcatcacggctcatattttgcaataaaccggtactgaccgccaccagagaggcatctcgacgagcccccgtcgcaaaggcgttaatatccggtgcctgataaatagccacttgtggcatggcgatccctacctgttgagactggcgacgtacggtttccaacaaccaatattctgtttcattacgtggccgttcaataacctccccgcctactgaacgtaaagccatccatttggacatcagtaacgaaacaaatgcgccgccgaaaccaaacagacccgccataatcatcagcccctgcacactgcttgactgaattcccgtcagacttaacaccaacccgaacactagcatcaccgccaggttggtgagaaggaacagagcgatacgcatcataaaaatttttccttattgtgattgtgttggtcaaattaatcgtgttgaaccaaattaatcgtgttgagtcatatttgtgttaaataaaaagatgcttggataaattactgtagatacgttaatcgtatgggcatctgataaattttcaaggtttgttaagttctaacaaaaaaaaatcaacgcaactttacaaatttggacgctttttattacatgttttatcatttcttcaccatatgagatccttggcagagcaacgtacatatccctatttattcattattattttgtagatcgattaagaatgagtcgctcagagctggtctgaaccgcctaggcaagacaccgtgacctctgattttaacaagggttaagcagcctgttcatccgtcatgcacctgaaaaaaagcaaaaaaaaatccgagtccaataagacccggattcttcatattatttgcagatttattttaccgttgccccagcggtagcggtagcagcagcgacagggcgagatgcaatctgtggctgagctttttcctggtgggctaaatccaaggcaatattcaccgtttcatccaaataagggtctggctcctgataatcttttggtaaatcatccaacgatttcagaggcttcttaccttcacggatgaagcgttcatttaaacgagtcaagcgcgtcatatcatcatcacggttctctttttcacgctgggcgtaattgagagagacaatgttacgcttatctttcaaagccttataacgctcaatatctttctgaatatactggaattcaggattagcggcgatacgctcagcatgattcttcagtaactcaggctcccagggtttcaaatcacccgttttggtataactggcagcattgatcctgtcccatggcaaagcattatcttcgaagttttcacccgtttccgccggatcaacccctgtaggcatcacgatatccggagtcacacctttgcgctgcgtactaccgccatccacccgataaaacttctgaatggtgtattgcagtgagcctaacgctggccactcagggcgtagcatttgatcgtatatacgattaagtgagcgatattgctgaacagtgcctttgccgaaggttggctcaccgacaattaatgcacggccataatcctgcatagcggcggcaaaaatctcagatgccgacgcactgtagcgatcaaccaataccaccagcgggcctttgtaatacaccacaccgtcagtatcactgtcttcacgcactttgccattgttatcccgcacctgaaccactggcccactcggaatgaacaaaccagaaagtgaaacagcttcggttaatgcgccgccaccattactgcgtagatcaatgatgatgctgctgacattctgtttctcaagcttctgtaattgcaccttaacgtcttcggtcaggccaacatagaaacccggaatatccaacacacctacgcgttctttaccgatggttttcaccgacattttcaccgcgcgatcttccagacgaatgcgctcgcgggtcaaggttacagtacgaggtttagtccctttacccgcaggtaaaatttctaaccgtactttactgccctttggccctttgatcagagcaaccacatcgtcaagacgccagcctataacatcaaccattggcttacccgcctgccctacaccgataacccgatcacccaccgctatcgttttactcttcgccgccggaccaccagggaccatagaattgatgagtgtataatcatcatccatttgtaataccgcgccaataccttccagagacaaactcatctcggtattgaactgttcagtattacgtggagaaaggtagttggtatgcgggtcaatctcgcgagcaaaggcgttcatgatcaactggaaaacatcttcgctgttgctttgcgtcaaacgcttaatggctgattgatagcgtttcgtcagcgtctctttgatctctttatccgttttacccgctaacttcaaattaagctggtcgtattttacttttgcatcccaaagcgcattcagttcggcttcactgcttggccacggcgctttggcccgatcaatatcaatcgtatcgttaccagtaaagaccattggccggtccagtactgacaacgcatattgatagcgttcaaaacggcgtttctgtgccagattgaataaggcaaaaggcgtgtctaattgacctgattttaactctttgtccagcgaatactttttatccgcgaactgtgccacatctgatgccaacaatacgttatggctgtaatccagcatattgaggtagcggtcaaatattttggcggaaaactgatcgtccaatgcaaattggcgataatgagagcgagtaaagcgcgatgttacgcgctcactcacggttgcatgctcaggttcctgacgtaattgagggagttgatcaattcgatacgttgtatcggttgcgtaactcgccccagccagtaacaagcctgcgattgctgctagtctgacaaatttgttcatgcctaggttggcctccgtatcagaactgcaagtgttctgcgcgcacaatcatcgccagaccggaagatagctgcacccgtacgccatctttagcgatttccaatacggttgcatccattgcactcttgcctgctctgactttgatttcttgaccaatttgcagtttagagatatctgtgaccggcacaggacgtggctggttttcctcaacctgtggacgaggtggccgaacctgttgcgggcgaggtgactgacgaggcttgcggttttccggagccgcacccgcttcacgacgcggtgcaggttttttacctgccggacgtgggcgacgtggctctggcgtttcacccgcagcaatggcagcttcgcgctttttagcctgttgttcagctcgttgtgcctgaacacgggctttcgcttcttccagctgtttgcgggcatgttctacatgttgttcttccagcacaccacaagggttgccatccaaatcaacacgctcagcaccgactttgaccccataaagataacgccagcttgaggtgtagagacgcagcgcagaacgcaattgcgttttgcttaaattctcttccccctgaacacgttctaccagatcctgaaaaataccgatcttaagagggcgtgcttcgccttcggcggtgaaacaaagcgggaaccgctcggccaaaaaggctatgacttctttgctactgttcaacttaggttgattttccatgaaatttcctgattacaacgggtttgccaaccagcgcaggcatgaacaggcgtcattataatgacgccatcagcaattgccacgttatccgtatatcaacttgcagtctctgtgacatatttggcactatcacaaaactcaagatgctcgcaaagccccgccacaactgagattaaacccaattcgtcgtcttcatcaaagcgatcataaacaatgctatcaatatccaaaatgccgataactttcccctttacagtgattggcagcacaatttcagcgttacttgctgcatcacaggcaatatgaccggggaaagcatgcacattacctacccgctgaacgcggttttctgctactgcggttccacacaccccttttcctaccggaatacgcacacatgcaatctttccctgaaaaggcccgagtacaagttgtttgccatcgaccaagtagaaaccagcccaattcaagccatcaaggcgttcataaagcaaggcactggcattggccagtgtggcaataaaattcgtttcacctgcaactaaggcacataagtcacgttttaattccgcgtagaattctgtttttttcatgtgatgaccgttagaaaccaaagaatagccaagggcaatgaatgcttggcttatataaaataatcattaaatacccttggcgacaagggtattcctctgtaatgttgcaaaagagttacctatgttatgaattcacctgtttcgcccgattacgccatcatgaaccgtgctattttttacaaaacgatacgatatactgatgacatcctatgtagagctaccctctatcccatgaaaatacacgcaattcaacgcccattatccaccgctcgagcccaacgatgctgcgagtgcgatgccctattcaccttgccaccattggggggcaaccaaacagcctattgcccacgctgcaacgcccaaataaccagtgggcgtgactggtcgctgacccggttgaccgccatggcttgcgccatgttgctgttaataccgttcgccttcactgaacccctgatcagtattcgcttacttggcacacgtattgatgccagtctgttagccgggatttggcaaatgagccgtcaaggcgaccccatcacagccagcatggtggcattttgtgtcctcgcggcaccggtaaccttaaccttctctattctatatctgcgtattggtagccggattggcataaatctgcgcccgatactgcttatattggagcgactgaaagagtgggtcatgctggatatctatttaatcggcatggccgtcgcctgcattaaagtcaaagaatacgctgacatcatgccgggtacaggtctgatagcctacctggccttgacattactgagtattctgaccttggttcatctgaatctggagcaactttgggaacggttttatccgcaagaacagcctccaggcccgcaggaaacactgcgcgtttgcttatcgtgccactacactggacaccccgatagccatggccgttgtccgcgttgccatacacctctccgacaccgccggcgtcatagcctacagaaaacctgggccgcattgattgccgctatcgttttgttattgcccgccaacctactcccaatatcaatcgtttatgccaacggcgcacggatagaggataccattttctccggtgtggtttctttggcgtcatcgggtaatttccctattgctgccgtggtcttcatcgccagtgtattggtgccgtttactaaagtgatcgtgttaatcacgttgctgctcagtattcacctaaagacacaacacagcctgaaaacccggatgcgtttgctgcggttgatcacctggattggtcgctggtcaatgctggatctctttgttatcgcattaatgatgtcgctaattaatcgcgatcagcttttttccttcactatggggccagcagccttctattttgggtctgcggttattttgactattcttgctgttgagtggctagatagccgattgatttgggatgcatatgcaacaggaaacaccgagtacaccgactgaggctcatgtaaaacataaacgccggttctcccccttctggctactgccttttattgcgctactgatcacgggctggctgatttataacaattggcaagaacgtgggacggaaatcactattgattttcagtcaactgctggaattgttgctggccgcacacccatccgctatcaaggcgtggatgtaggtttggttcaatccatcagattggatgataacctgcgtaacattaaagtgaccgccagtatcaaaaatgatatgaaggattcactacgtgaaggtacccagttctggctagtgacccccaaagcctctctggccggtgtttctggattggatgcgctggtgggcggtaattatatcggcatgatgcctggtgagggtaagccgcaaagccatttcactgcattggatactcagcctaaattccgcctgaatacaggcgaattaatgattcatctctctgcccctgacctcggctcactcaataacggctcgttggtttactatcgtaaaattccggttggcaaagtgtatgactacacgatcgcccctgataataacggggttattattgatgtcctgattgatagacgatttgccaatttggtgaaaaaggactctcgattctggaatgtttctggttttaaagctgatttcagcctaagcggtgcctcggtgcaaatggagagtctggcggcgctggtcaatggcgcaattgctttcgattccccacaaaatagccaagatgccgcgccagatcagcctttccaactttattctgatttagcgcacagtcagcgcggggtggccatcaccctggatttaccagggggaagtcacttgagtgagggccgtacccccctgatttatcaggggttgcaagttggtactttgactaaaatgacgcttcaaccagaccaaaaagtgacgggagagctaaccattgatccctccgtagtgaatttgatgcgtagtggcacacgcattgaaatgaatagcccgcggatcagcctcagtaatgccaacgtaagtgaactgcttactggtaatacattagagctgatcccaggcgacggtgagccacaacaacattttaccgtactgcccagcagtaaaagcctgttacaacaacccaatgtccttgaattgcaactcaccgcgccacaaagctatggcattgatgtcggccagcctatttcactacgtggtatcaagattggtcaggtgttaacccgcgaactgtcagccgatggcgtcacctttacggccgcgatagaagcgaaatatcgccatctggtgcacaaggacagcaaatttgtggcaaacagccgccttgatgtcaacgtggggattgatggcgttaacgtgcaaggcgccagcgcacaagaatggattgatggcggtattctgcttttatcaggtagcaaaggcgaggtatcaggtagcaagggcgaggcactgaaacaataccccctttacagtagcgtggcaaaagcaactgatgggattttaggcagttcaccggcaacgaccctaacgctaacggccagcagtttgcctgatatacaggccggttctgtggtgttgtaccgtaagtttcaggtgggtgaaattactcacgtacgccctaaagccaacgccttcgaagtggatgtttacattcaacccgagtatcgcaatctactaaccgaaaagagtattttttggtcagaagggggcgcaaaagtacaactgagtgggagtggccttactgtacaagcctcaccgcttaaccgggccttaaaaggggccatcagcttcgataatctagaaggcgtcactctggataaaggggccaagcggacattgtatagtaatgaaacggccgcacgggccgtgggtagccagattatattgcgtacatttgatgccagtaaactgtcggcgggtatgccaatccgctatttggggatcgatattggccaagttgagtcgctgaagctggcacccgagcgtaatgaagtcttagccaaagccgtactttacccagaatatgtgcaaaactttacccgcgcgggtacccgtttctccatcgtctcaccggagatctcggctgcaggggtcaataatctggagaccttgttccagccctacattaatgtagagcccggtaaaggggggcccttgcgcaattttgagttgcagaccgccaccattactgactcccgttatcttgatggcctgagcatcatactggataccgctgaagcgggttcgttgcaagttgggacgccagtcctgttccgtgggcttgaagttggcactgtcaccggttttaatctgggtgcaatgtccgatcgagtgcaggtatcactgcggataagccaaaagtttcagcatctagtaagacaaaacacggtattttggctagcatcaggttataactttgagttcggtctgataggtggtgtggtgaaaagcgggaccttccagcagtttatccgtggtggtatcgctttcgctacgccaccaaccataccactggcaccgagagccaatgtcaatcagcactttttgctcgcccccgaagagcctaaagattggcgaaaatggggaacagccattccacgttcttaaataattcatcagggtggttcgccataagctgccctgatgattacccgtgctcatgccctgcacagcaatcgccattcttataaaccctttttctaaattcctgtagcacttaccgctgttttctttttttatctctaaattcgtctctttattttccatcatctctatttttcttcgcctatttattcaaaagagaagctaatcaatttactcacccatcaataataaagtcttcatgtcgtttttttgctgaatggattcatattaaattttttttaaaaaaaataaaaataatattgaacctaaaataaatcaacattaggataatgaaatttattatttattgcgtcttgttggcgttaattaatcattcctttctctaatgtttagcaacaagaaatattagttgctttacattattctctcaacagcatcacgcaggtttcttggcggttaattatagggttaaggggggggtaatgaggaaaaccttatttactttaagtgtaatagccatattacagacagcaccacacataacctatgctgctgcaactaccggtacactgtcatcaacactgaccattatctccggctgttatatcaacgatgggaccgggtctggaagcctgagtaatttgggaaccataaacttcggtagtgtagtggcgctatcctcagtaattaacgtcgcattcagtggcacactgagcgggactctcagtttgtattgtagtgctaataccgcgtataccatcgctattgataatgggctgtacagcacgtcaggacagcgtcggctccggggtggggccgcagcaccaaccacctttgagtatgttaattataatctgttcaaagacagtagttacaatcagccatggaacgcaaccccgacgacgggtgttcaaagtggtaccggcaccgggattgccacgcctattcctttgactatctatgctcaagtcccgatacaaacaacgcccagtgtcagtacttatattgatactgttatcgttactgttacttggtaataacagtgaaaaatcacactcttgttgtattcagtttaagtctcgtgtgcggtttactgctattccaagcatatccagtaaatgcagtatcaaaaacagccaatataacggtaacggccacgctactgcccacctgccttgcgcgttttctggtcagtggcagcacaagttttggcaccttggattttggatcaactgtcgcgttaacccaaccaatctcggtggcaggtcaaaccaatagtggcgctatcaccgtgcaatgcagcaacggtaccagttttaacgtattactgagcagcggacagagtggcaataccaataaccgttatctgtccggggggccatcagcccagcaagtgagctacaacctgtataccaacgcgacctatagtgtcatctgggatgatgtggtgggtgtatcgcaggttgctaccggacaagtcgtcaccataccggtttatggcctggttcctgcacaatcgacgcctgcggtagggacctatactgataccgttcaggtcacggtgagttggtaagtatagagggagggctaacaatgataagtcttttttctccatgtcacctcagtgccgctttacttatctcagcactgtttatcgtacctaccaacgcagcaccctcacccgtatctagcccttttactgtcaacgctaccgtgctaactggatgtgttctggggggaggcgcaactgacagctccaattttggttccataaattttggcaatattacttcgctggcaaccgccattaatgcaacttctgggctgaatgcaggaaccattaccattcagtgtaatggtaatcctagcgtaacacttgcgctcaattcaggggccaacatgacgggtaacatctccgcgggtaggcacctgcttaacagcagtaccggtgaatacttgctgtatcaaatttatcaaaatagcccccgaacccttatctgggtagatggttcaaatgggggggcaacacaagtcattgctaccgacggcacgctacagcaagttattttatatgcacaactgtttgccagtaatacacaacctactgcgggagtttatctagatacgttattggttactgtcacttactgatcaataacacataccggagaaaaacttacgatgataaaatatcacttattatctaaattgatattatcctttattttgctacccatcgcccctctacatgctgctgtttccgtattaatttggcccattgacccagtcattaacgatgacgaaaatgccacagcattatggctggaaaataaagatagccaaccaacttatatgcaaatacgggtactgagttggcgacaggttaatggtctggacgactacaacgctcagactgccattattgccagccccccccgttgccaatattcaaccaggcaagcgccaactgattcgcttagttaagaatgcacaagttcctgcgggaaaagagctggcctaccggatattaatcgatgagatcccccgtcaggaacctaatgataaaaataacccgtcatcaacacaattgggtctgacatttcaaatgcgctattccgtgcccctatttgtttatgggaatggtatgcagatagcacccgaggcgacacaaccgactgatattgcacaacctacgctcagctatatattgaatcggcaacaggggaagcaatggctgacgatccgcaatcaaagtgaaattcatgcacgtatttctcaggtcacactcaacggccagacggttaacaacggcttattgggctatgtattagcgagatcacagatgagctttcccatcagcttagccgccagaaaaggtgagttggcggccattatcaatagcaacaccaaaccagtaactattccatatcagtaactagcccatatcagtaactattccataccagtaactagcccatatcagtaattgagagacataaaaaaaatgagattttacacaatgaactgaggatcgaggatgattatcagattccggctaccgccattatcggtactgatatatggctcaatattgttaccgtcactgatacccttgactattttaggagggagcctccctccgccctcgacatcaacaacgatgcctgatactacgttatatcttgaactcgtggtcaatgaccgtaactttgggagtgctgtacctattagttaccgcaacaaccgttattacctttctcaatcacagctaagaacgattgggcttcctatatcagagccactggcacccgagattgccattgataatatggcgggcgtgaacgttaaatatgatggagagaaccaacgcctattaatcaatgttcccagcgagtggctaccaaagcaacaaatcgaggttaccgaacaagatgatttcaatcttgcgcaaagtagtttgggggctttattcaattacgatatctatgccacacaaggttacccgtactcatctttaactcatttttcagcatggacagaacagcgcatttttgatcgttttggcttgctcagtaataccggcgtttatcgcacccacttcccaagtaataacaacacagatgatgcgaaaggctatattcgttttgatacccagtggcagaagaatgacgaagaacatctgctgcgttatagcgcaggtgacctcattaccggtgctttgccatggagcagtgcgatacgtcttggtggcattcagatagcacggcattttgctattcggcccgatctcataacctacccattaccacaattttctggtcaggccgcagtccccagcaccgttgatctctacattgataacttcaggacacaatcggccaatatcaacccaggcccttttgtcattaataatgcaccgcgaatcaatggtgcaggccaagcgactatcgtcacaaccgatgcccttggcaggcaaatcagcacatctgtacccttttacgttgccagtacactgctaaaacccggagtgtgggatttcagtctctcggggggtgccctacgtcgtaattatgcgattcgctcagcagattacggtgaaatggttgccagtggtgtcgttcgttacggcacaacaccttggttgacactggagggccggggagacatcgccaaagaaatgcatgtaattgggggtggcgttaattttcgcatggggttattgggtgtcctaaatagtgcatacagtataagcaacacatcgaacggcgcttttaacaatgtggctgaaccgctaaataccaataatgccacgtcgaatagattaccgccccctgcggcgtcacgccgtggacgtggcaaccagcgttcattaggctatagctacagtaatgcattctttaatttaaatgctcaacatattatctctagtgatgaatacagtgaccttgccaattataaaacgccttctctcttaagccgacgcatgactcaactcacgggaagtctcagcctcggtagttacggcaccgtgggatcgggttactttgatgtcagggatgctcttggcgaacaaacccggctcattaatatcagctacagcacctcactgttacgcaatagcaacttttatagcgcactaaaccgtgagctgggtcgtaaaggttacaatgtacaactggtctggagcattccgttaggcccacggggatcaagcagcatcagtgcaacccgcacgaatgataaccaatggattcaacaactgaattatagccgttcagcgccctcgaatgggggattgggctggaacctcgcttatgccaacagcacgaataacaataatcaataccaacaggcagacattgtttggcgtacttcaatgatggagagtcgcacgggcctatatggtaacagtaataactacaactattgggggggattaaccggttcattagtggtgatgaataggagtgtctatgccagcaatatgattaacgatgcttttgctttggtatcgaccaatggttttagtaatattccggttagttacgaaaatcaacttattggcacaactaatgccaagggttatttgctgatcccgacagtcgcctcatattatcaggcaaaattccagattgacccaatgaatttaccggcagatgtcatgctacccaatgttgaacggcggttagccattggtgaacgcagtggctatttaattaatttccccattaagcgaatttccgcagtgaatattagaattacagacgcatcaggccaagacttaccgaaaggcagtgcaatatatactaccggtaacatccccataagttatgtcggttgggatggcatggtatatatcgagcaagtggcacaattaaataaccttaggattatacgtgccgataatggcacacagtgctacagccagttcaaactaaagacgacggaaggtatacaggatgctggcaccacagtatgccgatagtcgctacatgatgctctcaatatacccaaaataattcgagttgcaggaaggcaacaacagagtaggtccccaggaacttatttattttaagggcaacgacaggtaattgactgaggtgacaacggttattgacacttagcaccgagaacagatttgaatgcagcttgaaggacgacaggtataaacttcatatgaggaacgacgaatgttatccatcaccagagaaatcacaaccataacgaacactcccaagtattggcttagctggcgaacattacctatattatggctattttatgtagggaatacattagcctgtacctttagctcccccaccgttacgctcccacccaattcgtcatttaacgtcaataccctaacagaaagtggcagcggcaccattgcaatgctctgtactgggaccggtgtgagcctattggcttctcctgtattaaatgcaactgtagccagtaccaccaataccttgaggctaaaaaattcagcgggtgactttattccttatacaatttattctgacgcaggttataacaatgccattgctataggtagcgtgataaattatgccggcaatagcagcttactcattgtgacgcttttccaaattagtgctaacctccctatttatattcgaactggtagcaataatgctattaatgttaacgtcagtgccgggacatataccgatgtcattaatttaaactggaattacgatttatgtgctatctctctatttagcctctgccttggcggccccttcagtgggacagcgacctctaccgtgacagtcaaattaacggtcagtaatgactgcgtcattaacagtgcccccaatgttaatttcggcagttatgcattaattacccagtttgctcctgttaatcaaaatatctctgccacctgcacaaaaaatgctactttcacgacctacataaccaatggaaataattttgtcgcgccatggcctcgaatgaaattaacctctggaactgactatttacagtatcaactgtatcaaggggctggagtcatcccgtggaatgtaacgaataaaagaacaagtaccgcgacaggcactcagcagttgatcccttataatgcggtcattaatccgcagcaagcacaaaaaacggtgggaacttatcaagataatgtgagtgttgtattggaatattgaattgaagagccgtgcatacctgaatatatctcagtgttatgtttccaagggctatttggcttccaagggttatttttccgaatactcgttcgcttccaagcgctattttttagagaatacctctggcgattttcttcagctcagctattctcaataaggctgtcaatctggtcatacctcctgccacactattagtaaggagcctttatggggaaaagcatcgtaaaaatcaggcagtttgaagttgatgatgcagaattatcatcacagacaaaaggtgagcatacgctcagtattccatgtaaatcagaccctgatttatgtatgcagctagatggatgggatgaaaacaccagtattcctgctatcttggatggcaaggatacgctgttatacaagcaacattacgatcaacatcaagatgcctgggttatgaaggtaacctgaacatggcgctaagaagatccgtcaacccatagttcatgcttatgagtgacggtttcttctcttggaacgtggcgaagctaacggactaaaacaacggcctgatacagcatcagaaggtttccagtactttaaacttcatacagatcagcatcatatctggggagaacatatcatactcctcgaaaaagcgttgttgagttttacgccagtaagccagtgtactatcgccttcaccttccgccagtgcatgcgcctcatcaacttgatcaaacgttttcagttccacctcggttaactctaccgcacatgctggctgattccggccattaaccacgacaaatatgtcacccgccagaggaaccccctcgtcatccaatgctgcacaggtcgccgttttggtgccattcagtaccaatgccaataactcatccgcaacctgctcagtatcaccaaatgcccaacgttcaacgtcttcatatttctgtgggagtgtagccataatctaattattcctattcgtaatattattgatgcagcgcatattacactttatattaatcagcacgaactgactaactctcgcatcagcataaatttccgctactatacccgatacttcaagtcattggtgttgcagccagaattatggggaagatcattgattccggtgagtcaaaaccactcacgtctggtgcagcaattcatcaggctataatactcaaatcatttaaggacctatggtgaccaaacgcttagctaaaaagcattggaaaatgtttttggtgttactgtgcatctgtgctgcattgatgctattacggtgggcatcaatgatctttggctgatttgatcatggctgaggtgtgtcttgtggcaagaataaacagccacacttcgggcagatcaacgcgatatttttttgcactttctccgcactctgtacagaatccgccctacatcctgggcacttaatctgtacccgtacaccgttcaccagttttttaagattatcaagaaatgacatactctcacctctctgttgtatgactgactcagcttacgttaaccgccaatcataagccgtggagtggtcaacatttactcactttattgtcgccaaaacagaacttttattgtctgagataactgatcttatgtgttacagggagagagaggtcgcgtgggatagatagatagatagatagatagatagagtaaaaacattcaccacgcggcatggctggcatgcttggcgtagtgaaatggtaggcagattattggaaatgattgagccgggatcagtgattccataattcttggatcaatcccctgacccgaaccttggatgcaccagcaaccaggctaatgatacggttagcgctcaatgttgaaacgtcagtattccattcatcgaaagagtgttccgagtagctatcgctgaacactttttttatcgaggattcagcttcagacatctcactgaaattcttagcgtttattaagcactgagcaatgattgagacttttttcatgttttatccttgattatcggtcgcatagtgtagcacaattacaccccctctgcttatatgctgcttaaattgttttcaattggtgctaacagtttgataaagcagcagattaactattttctgttaaccaatccggtcttctctcctatcgaatttaatccgctggcatttggttagtctgtattgtggccgcttcctttaatagcacctccatttcaatagaacccggtggccgcagcgaccattcaggccctcgcaatccttcggcataacccgcctgatacaggcgttccatcttgactggatcaaagatttccgcgccattaatatcgacatcaggtgggatcgttatccaatgaaatcccgattgctcagctaaagagaaagcataaatacggtataaatcgccgactaacgcagctttactggttgagtccaaggtccgcaaagcaatattacggactaaacgcggggttggctccggctgaggaccaagttgaccgttatgaataatgtaaatatcttctttgctgtcagctaaacccgctctggcgcgtaccactttcgagctgtataccccaccattatagaaaacccgcgcggcaacaccgccatccacgtgcatctcatcatagtgtttaccattagccacgacatcgaagaagaccggtgaaaatgcgacgggcacagaagaggatgccaacatcaccttacgaaatagcatcaaggcttctggtgttcctttggatgcgataagccccatgttccacacaataaagcgttgtgagtcaagatcaactgtccccatatacaaccgacgcccgcctttatgagccttagcaatttcactcagcaactgcggggtaatatggccatcaatcaactgagacagcggactggtatctgccaatgattcacggaaaaatagcctaaacaacagattatttatgtgaaaaatatctcgagtcgttgtggtggtataaaaatcatgcagggctttatcgtggtcactgcccaagaaagcaaaaggcgcgatcaaggcccccgttgaaaccccactaacaactttgaaaaccggacgtttacctgtttctgtccaaccatttagaaagccagcaccaaatgcgccatttggaccaccaccggacaaggctaaatgcgggtacacccgtgttccgtcagcctgacgaaacatctctttcgattcatctttataggattgcagcaaatctgcttcaaatacggcgctaatgtgccctgccccagcgcgaatatttggcattccagggatctcagcggcaggcattaacgctacaggcactggatttcttgggagctggctacaggccgccaaaaaagagattccgagcagtaaagctatggagcgaattaatttccaacgcgttatcattatatttcctagccaatactgcagaatatctacccgttaaacatatactatttttatgcttgcttcacaaactcaacactacagattaagccattattgacgtgatatgtgatacccgcaaaatgccgaacccatttttatacttaggccattcaatagaagggtcaggctgctgacaacccccgatgacgcgatctgaaacggtgaggataggcagaagagtaaagcgtccgcgccagggagggcgcggctcgagcccccagggatgggttgacggcgtctttacgatctgcctgttctctccgtcgctaatactttgtcaataacctcgccattcaatagaagggtcttttattgtggatattgaatctaattggctaaaattaaaacgattaatctactggcgattgttcatccagaatcgtcaatagggtatcagcatctggcgtcgtgatgtgtttcccctcaaggaaacccgctaatttagactcaataccctgttcgtacacttcataaccgtcgattcgatagccagggatcccatcttggttgcggatatattcatcgccatcgatataatactcaacgctaccgtgggcatcttcaatctcgtaacgtttatcaaaaggaaactgtttcatcgttcatcctaaaaaccaatatcatcgttatatgatgccaatttaccgctattttaggaagcaataactgtgatctcccacgccggtgttcccccctataggtacctcactttcacgcaaaaaatggccatgatctcccgttagcctctttattattgactcccttgctggcacctaaaggtcacaatacaaacagaatcctcagtgaaaattgatacctatcggaagtaatattacgtgaaatcagtgctctgctcgctctggttattgccatattggatgctaaaataaaaacccagtggcttacgtcttgccgccagtttggtgatcatgacgggtgttgttatggcggtgttgttatggcgggtgttgttatgacgagtattgttatgactaaatttggctaactcatattcgagtagcccctctctaacgttttattgcctataaagcgagagcaacgattactgataacaataaatactgataacaacaaagcccccacaaaacacgctatactcatataaatcctataacaaggaggctatatgctcatagggtttgttttactggttagtgcttgcggcatggatgcttgtgaggcgcttccggtgacagaagatatttattcaacacgtcatgaatgcatggatgtggctcttcgcctacatgaaagaagacccgatgtggtattgctttgtggggaagtgtatcggcagcctgacgatgaaaaacatccttaaaacattctagggcagaggtccatcagcgcaaaatacccgcgtcttcttactgtactttaccgctaacagagcctctccctcttctcttccttttctcttctatcccatgttacagcaagcaaataacgttaatcacattgaaattaactgcgattagtctgtttaaacttaacgccatgtagcgcatacacgaaaaaaacaggtaaatatattgtttaatcttttttttgagcccattccaactgtagttttaatatgttatatcggaccaaagttggttagatgtaatataccctccgaacaaacctcgtcacaaaaatatatttttaataaaaatcttataccagttacttcattgttttagttaaaaaactaatggaaaatttattcaggagatttcatgcacgttcgttttcgtcatttattcttattaccattaataactttggtcgcttgtagccaacccgtatcaaaaaaccatcttagcctgacctcactatctgccaacgcccagcaacctgtagtaaataatgcgtggcttgaaatctctcaaggtgcgctggatttcaatactaaaaagatgcttacactgctggataataaatccacactttgtgcaatattaaaaggtgatgcctatggacatgacctgaccttagtcacaccggtgatgctaaaaaacaatgtgcaatgtattggggttgccagcaatcaggaactaaaaatggtacgtgatctaggatttacggggcagttgatacgggtcagaagtgcaacattaaaagaaatgcaacaagctatggcttacgatgttgaagaacttattggcgataaaaccgtcgctgagcagttaaataatattgcaaaactgaatggaaaagttctgcgtatccatctggcactgaactccgcagggatgtctcgtaatgggctggaggtcagtaaggcccgcggtttaaatgacgcaaagacaattgcaggtttaaaaaatctgacaatcgttggcatcatgtcgcactacccggtggaagatgctagcgaaatcaaagcagacttggctcgattccagcaacaagccaaagatgttatcgcggtcacggggctaaaacgtgaaaagattaagctccacgtcgccaatacattcgcgaccttagcggtgcctgattcatggttggatatggtccgtgtgggaggggtgttttatggtgacaccatcgccagcacagagtataagcgggtcatgaccttcaaatctaacatcgcatcgctgaacaactaccctaagggcggtactgttggctatgaccggacctatacattgaaacgtgattccctgctggcgaatatccccgtgggttatgccgatgggtatcgccgagtatttagtaatgcggggcatgtgattattcaaggtcagcgcctgcccgtattaggcaaaacatcaatgaatacggtcatagtagacgtcaccgatctgaaaaaagtgagtttaggtgatgaagttgtcttgttcggtaagcaaggcaatgcggaaattcaggcagaagaaattgaagatctcagtggcgcactctttaccgaaatgtcaattctgtggggcgcaaccaataagcgtattctggtagattaagttatttcaccgtctgttttcattaacactgtcgtgaaaacagacggccagtattgcgtataacccctttatcccgataacttgttttcaacgagtgacgcgttttcacaggacgcgttgtctgcacgagataattcgcgcttactaccccataacggaatacaggaaaaggcagagggaaagaagcacaatgccaacagtgagagatattttaccagacagcttttgtactttgactattccataaatgatcagacatatcgaggttaagaggcttacaccaaaaacggcgataataaatattaatacttcttgcattttatcctagagtcctttcatttgccgattaagctgaaaatctaacatacttatgctatttaatcccccttcaatatatcaatctatctatcaataaattttccggcgacccaacaagagagtgcccatgctcgaacgctctcagtatccgcactaacgacccaattaactaaaaataatcggtctatctcatcatacaatcaactgccttttcagactgctacctccgatacttttacaacctgcctattatctcctccactggcaccttgtcatcaacctcagaggaaaacatcattttatttatgagaaagtgcttcaccttgtatacgctttgccaaaaccggttcactgtacgaagtagagagaaaataatccttccccagtaacttcccgccctcataccatgggattttattgaagtacaaacttaaaccatcgtatccatactcaaataaataaccatcactgctaatgaacttaaaatactcatcagagtaaataattaacttatagtgagtcccgccactctcggcatgaagtgctttaacgcgttgcagataggccagcgcatattcactaaatattttcttagcttgtactgtatattggtcagcagtcaatcctgatttcttttgcaactctactgcaataattacaaaaatatcagcatcggccctcgcgacagacaattgaacccgaagatattgcgctaattttttggcatcaatactcagtgttttttctttcgttcctacttcattttttttccctgacgagacacccgacggtttatcagtactcgtcataaactcagtcggcttaggtaccaccataacagaattggcaacatacgcggcacaaccgattatacgactggatttatcagtctccaccaataacgagagaggatgtccctgctgaggaatattactgatatcaataccgaatttcactaatgtttgcgctacttgctcttgagaacgctcacctctggccaatgcacacacctggctcatgatcagctctttgtgcggaccatcgactgcgggcaccaaacctgcgacagcttgttgaatcagcggcaatgccggtaattcgaccctgtgcggctctattttcggggtattattgacactatgtttataagttgcatcgtacttggtaagtaacaataaaccggttaagagcagtaaagagaaaaacagtaacaatgacgatatgatcaatccagtggttttgagtgatagcatgggtgctgccttttaatccctaagaagtagaatcgggctgtgcaaaaaatcgcacaacccgttaatgattattaaacaatattcagtgttggcctttctttaccattgataaccgacgccgacaccaacccccatatcgccttgtgtattagaggaggcctgcaatttgctgacccatcgcccactgtcagaaatactcgacacccccaccgacagcgccgactggccccgatagctggccgcaccaatggtcgccatgctggcacccggcgtatagggttgagtcaggctcgccatcgccatggcaccggcgatccccgcacttaacgtactatcctgttttttcagatcttctttaagtgcagaatagcgctggtctgtataagcattggcgtcgttggtgacattcgacatgctatggttgagttgatccagattcaccgcatcagtgccctgagtccccacagcaatattagtgagctgccgttcattacccactgaccccaccgagacactgttttcacgatccgccactgagttggcccccagcgcggtgctgtttgccgccgtcgccttgctgcccgtacccatcgcggtactgtggctgccagacgccacggagcctgccccccccgccatcgcatcagttccggtggccgaaggcttggcctgaccgctgttgttgttcacctggaacatcccgtcagtgccgttctgcaaccctgatacggtgtcacccaccgccgccattgcaccatcgagttgccgcagattgactgcatccatggcctctcgcccgtcggcaacgttgctgaccgtccgggtctctccggttgccgcattgcccaccgacaccgtacctgaggtggtgttatccgcagtggagtacttgccggtgtagctctctgcaccgcgcccgttgtcagcggaaccctgccccagggcaacactgccctctgcgctgacgcttgctgcatcacctatcgccaccgcaccgttaccggaggccagcgtacccttgccggaggccaccgaagccgtacctgacgcctgcgcattcggtccgatcgccaccgaatcactgccgctggccaccgaatcaggctcggtggagtgggtgtggaagtatttcacgccgcccccgttggtgatgctggtcatctccccctcaacattggtgacccggccgtctaaactggtgatgtcagcggtattctgatcgaccttgtcaccaacagcggtcaattgcgcgacattgaccgcatcataatcagccgaaccggctgccacaccggtgatcttgcgattcccctgtgccgtgcccacccccacctcgcccaccgacgtttgggaagctgtcagtccgtacgcactgtagttgctctcagcaccgaccgtggtgaccgatgacgcccctaacgcaatactgtttgcctggctggcagccgctcccgcccccaatgccagagactgtgctccctgcgctgtcgacccggccccaagggctatcgatgtggtaccggacgcctgcgcattcggtccgatcgccaccgaatcactgccgctggccaccgagtcaggttcggtggaatgagtgtggaagtactttataccgcccccgttggtgatgctggtcatccccccctcaacattggtgacccggccatctaaactggtaatgtcagcggtattttggtcgactttattaccaacagcagtcaactgagtcacgttgaccgcatcataaccagccgagcccgctgccacaccggtgatcttgcgattaccctgcgcggtccctatgcccacttcccccaccgacgcctgcgtagtcggcagtccgtatgcactgtagctgccctgagcgcccaccgtggtgaccgacgacgcccctaacgcaatactgtttacctggcgggtaaccgccccggccccaagagccaaagactgtgccccctgcgcctgcgttccggcaccaagggccgtgctggcggtaccggtcgcctgagtgttggggccaattgcaatgcccccgacagcactcggcccaacaacggcgctattaccaataccaatcccgttattaccattgaccaccgtcgccggcccgacagcaatagcatcctgacccgcaggcacggagtcttgcgggttcactgagttggcgtggaaatagcgggttccatcttggatcaccgtataaagctggctaccaaccaccgcatcggtggaggtcgatgaaaccgttgcgggggcaagattggtggctttcctaccgttcaaaaataaccccccctgcacgtaggtatcaccgttgataaatgcaccatttttttgaacgacaaagccgtatgctgtggcgacattactggtgccaacggccgtcgtgaatgtccctgtccagggggtgggagcgtaccctgggagcccgccttgtccgccaacaaatagctgccccccattggtattcagattcgcctcagtcaacgtattacaatatatatggttagtaacaataccggtgatcctccccttaaaattcagattattatcatccacaacggcataacagccaggatcattggcattgttcacatagagttcagaaaatgcagtacctggcacaaatatcgtcaccataaaaatagcaagcaagccgcgaaaagaattgtctctgataaaggaatctgaaactgcaaatctggccagataattacagtcacacttttggatacttttcataccatccccattttattcttgttcaccttttgacattggtgacaaattattaagcaaagacgttcaaacccgctcctgtatggcactgagtgaatcgaagttaatcgtctatacgtctgcctcaccgacagccggtgcctaatcacaataaaaatttactattggttacactagggtgatatttttccgaaggatgatctccctctgaaaacatcaacgataaaaagaggcagcagtacagccacgcctataaataggcatgcagaattcattaaatagtgcggggaataacgtagagaaaggcccaaagaatgagctgagcctttaaactatgattagcggtagaaaaaatatatttaaggtttatatttatcgactaatgcatagaggatcgcaaccgtttctgcatccggtataccatcataattacatggccgaaaatgaagttggaaagcacggattaattgattatatcccacctcactgactgcgccagacgtgtcataaccatatcgtttcaattttgaaataatatcgttttttgatggcaggccacaaagaaactgctccagataccgttgcttagtttcatcgtcataccaggcaccaatacctgcatcataaagcgccttccacggaaaggctgcacctggatcactttttcgaccaggtgcaatatcactgtggccaacgacattgactggcgtaatatcagggaaacgataaagaatatttgatgccaacgctttaattgccgctatctgggtaacattgtagggcgggaaagtgaatacgccatcgttatcagtagcaagattaacggtctcaatccctatagcggtgtcattaagattattccgaccatcccaataactcactcctgcatgccaggcacgctcattttcatcaacaagattaaaaatacgcatatccttaaaaccggcatcaatataagtttgttccgtcggatcggggaccaggtaatgagcgcttaccgaaggccccgtgagtgcatcgatagaatctttaaaattgagggccgtataatgcatcacaagaaaacgaacgcgtcgattgaatccttttactgaacgaaaactattataatcaatattatacataagaatccttactcaataaaaatgaatttaagtgttaacacatcactgtatataagccagccacaatgtatgcgccgcatcaatatttaatttttttttgacatagatgcaacattatatttaatggatgatacacctcgtcacgatgatccggataacagaaaattgttattagcagatggtattaagagcacagttaacaccaataaatcggtgtatatagctgtcaccacgttgatttaattaactgcagatatacccgtcagacttcaagttgcctgtaggttagctgttctcgtgcaattcgaattattttgaacatagggtggcggctaaaaaaggaatatgaatatgaaaggtcatttttcaaggaggaatatgtgattacagtgcagattaatttttcgtgaatctttttcttacaaataagatcagtctctgtgctaaataactcgagtcacagataataagaagtatgacaagtataaaccggcagggacaattccctaccggttagcgctatcgataacgtcattaaaaacctaaactatccagcaaatcatcaacctgatcttgactggcgataacaccggcaacatttttatccatctgcgggccattaagtaaactgtccgtcggtttctgcggttttgacgggatatcgggaatattctccatcaaaaccatgaggagctgtttctcaatttcctgtaccacatccatcatgcgtttgataacctgaccggtcaggtcctggaaatcctgtgccatcatgatttccaataattgcgcattggtaaatgaagtgtgctgtgggacaaccgctaaatattctcgcgtatccgtgaccagtgaacgggcatctgacagctcgattggattggcaaaccactcatcccagcgaatttttagcgcctttgctgatgattccagttcgttctgacgcggttgtgccgcctcgacacagttaagcgccctttctgcggcctgtgctgtcatatgaaccacataatccagacggtcacgggcatccgggatcgcttcggcggcctgagcaatggcttgatcaagacctaactctcgcaaactgtcacgtaacatccgcgtgagactgccaatacggctaataatatcactggctgatgccgcatcggttgcgggcattggatggttattcatctcgcctccttacatacccaacttttcaaaaatcttattgagcttctcttccaaggtcgcggcagtgaacggtttcactacataaccactggccccggcttgcgctgctgcgatgatgttctcttttttggcttctgcggtcaccatcagaacaggcaacgtagccaaagcaccgtctgtacggattgttttcagcaagtccaggccatccatattcggcatattccagtctgaaaccacaaaatcgaaaccacctgctcgtaatttattcaatgcgtcaacaccatcttcggcttcttccacattgtgaaaacccagctcttttagcaggtttctgacaatacgacgcatggtcgaaaaatcgtctaccaccaaaaatctgagattcttatccgccatacccactcctaaagtttgttgctcagcgctgagcgattaaatgcaatagcccgatggttatcggaaaaataatttatagacccccatcataatgagatctctatatgcgaagggcttgaccactactgatctgcgccaacatccgctgacttatttggttcaactccacgacgtcattaaccccccccatcgcaatcgcctcacgtggcataccaaagaccacgcagctggcctcattttgtgcgagggtgtaggcacccgcccggtgcatctccagcaagccagcggccccatcattgcccatccccgtgaggatcaccccgaccgcattgcgcccggcatactgcgccaccgaacggaaaagaacatcaaccgaaggacggtgacgattaaccgcgggtccgtcatggatccgcacctggtagttggcaccactccgggccagttccaagtgccgatcaccgggtgcaatataggcatgtcccggtaatactcgctcgccatcctctgcttcttttaccgtgatttggcacagtttattcaagcgttcagcaaacgaacgggtaaatcccggcggcatatgctgagtgatcagcaatgccggactggttggtggcaaaggctgtaataccgcacgaatcgcctcagtaccgccagttgatgccccaatggcgatcaatttttcactgctgagcaatggggtatggctgagcatcgccggtttattttccaggacgcgctgtggtaaacgagccttagccgccgtgcggatcttatcggcaatcagttcgctgtaagccagcattccttcgcggatccctaactgaggtttggtgacaaaatcaatcgcccccaactccaacgcccgcatggttatttcggagtttttacccgttagggaagacaccatcaccaccggcatgggccgtagacgcatcaatttctcgagaaaatccaagccatccatgcgaggcatttccacgtcaagcgtcaaaacttgtggattaaattttttgatcaaatcacgggcaaccaacggatcctgtgccgcagcaaccatctccatatccgggtgactgttaataatctcagtcattagctgacgcattaatgcagaatcatcaacacacaatactctgactttactcatcacctctccttggtcagcccataaacggtctgcccgcgcaaatagaattcccgactgatctggctgaaattctccgagtggccagcgaacatcaggccgcctggttttagcaaaggtacaaaacgacgcagaatgcgttcctgcgtctctttatcaaaatagatcatgacattacggcaaaaaatggcatcaaattgccccggtagtgcccactcaggtgccagcaaattcaactgctgaaactggactaaattggtcagttcaggccgaactcgcaccatgccctgatgcgggcccgtacctcgcaaaaagtagcgttgcatctgctgggttgacaatgagcgcaattcatcttgccgatatacaccgctggtagctttctccagtacctgtgtatcgatatcgctggccaatatctggcaggctcccgcgcgatttcctaacacatcacacagcgtcatagcgatggagtaaggttcttcaccggttgatgccgccgtactccagactgaataaccgcccgcccgctgacgagcatgttctgccaagagcggaaaatgatgagcctcacgaaaaaatgccgtcaggttagtggtcaacgcattcacaaatgcctgccactcagcactgttcggatcactctccaacaaggccagatactgaccaaaatcagaaatattcagtaatctcaaccgtctgaccaggcggttatagaccatttcccgcttatgttcagccagaacaattccagcccgttgatagataagttgacagatacgccggaagtgaatatccgacagcggcaaccgttgaatcatttgggtcagtatcgacccggactcttgaggtaatgattgaggcgctgacttcattgatgatcgtttcatccaaccttaccccccaataccgtcttcgttacgctgtttgacactctacgatttcctttacagccacttgtcgttactcgtgatgacccgttacgagtgatgatcgattgtcactcctggtcggaaccactcatgctgatcgacccataatgagcgactaataatgcgtggccaatgattgctggctattgcccgcaactgactgttcgtcgtgcccctgccccaaacggaaaacagagacggcatcggagagcaggctggcctgctcttccagtgcattggctgccgccgcggcctcttccactaatgacgcattttgctgagtaacctgatccatttgcgttacggcgagtgatatttgttcaataccccggctctgttcatccgaagcagattcgatctcccccataatgtcagtcacacgcgccaccgagcggacaatctcttccatggtagttcctgcactttcgaccagcgtagacccctggcggacacggctgacggactcatcaatcagccctttgatctctttggctgcttgcgcactgcgttgtgctaaattacggacttcacccgcaaccaccgcaaaaccacgcccttgctcacccgcacgggccgcctccacggccgcattcagtgccaaaatattggtttggaaggcaataccgtcgataacgctggtgatcgcaccaatcttctgcgaactggtagcgattgcatgcatggtggtgacgacactcgccgtcagttctccgcctttagctgccgtaccggaagcctcttgcgccagtaccgtggcctgatgcgcattgtccgcattctgttttaccgtggcggtcagttgttccatactcgcggcagtttgttccaaggaagccgcttgctgttcagttcttgccgataaatcgttgttacctgcggaaatttcctggataccggtcaacatcgattcggtaccctcacgcacattgctgaccgttgagatcagcgactgctgcatggtgcataagctggcgaacatctggctgatttcattacggccagtcaccgagatctgcccagacaaatccccttgagcaatgcggccaaaatgctcacgcatcgtcgctaatggccgaacaaacatgttgcgcaaccagatcaacgacgaaatggccatcgtgataaccatcaaaatcgcaccactaaatatccagattgagagctgataagcctgctgattctgctgaccggcatcggcaataacctcattggcgtattgcaaatactggatgaaatccgcttcaaacaaatcttgcgttttctgagtgggttgatccataaatgcttgtaaatcacccgcttccagaaaatcaattaactcacgtaatgcgctacgaaggttttgataactgtttttggtcgcatccagtaattgaccactgctctcactctcatcaaggcgcggtaccgcctgaaactgattaaagtaaagttcagctttctgcaatgcactgcgcgcactccccattaaagcgttaacttgctcctgaggaacattgagcgccgagcgagtagccgcacggtttaaggtattacgtgcctgaagcaaagatacccaactgaggcttaatgcatcgcgttgctgactacttaactccactcgatttaaattttggtagtctgagcgaaaagccgtaaatgatagaccacttgaaattaactgtatggcgcaaagaaacatcagcagcaggaaaaaactggtagaaatccggatttgaccaaacatcgtaacctcttctcagccggctcataggccgactttattaatattattttgcatacacccaaatcaattggcgtggcaggtaaatggccagcaggcggatcccgatgtgctgactcaagtttgtgattcggatgagtgcgcgcagctaacacgtcaacagcgtcaagctcgaaggttataaggtctagaaagtttcccaattgtcttgcagattatttcccagcgcttttttagccgtgctgttcatttcctgcgtgggttgtttgacttttctgacgtcactagtggaattactgttatccacactcagaacaaatacggacatcgcttgagttaacatgctggcttgctcttccagtgaagcggcggcggaagccgattcttctaccaaggaagcattttgctgtgtcacgcggtccatttcggcaactgcctgaccaatctggtcaataccacgactttgttcatctgaggcagaagcgatttcgcccatgatgtcggtcacgcgggtcacggcattaacgatatcgcccatggtttcaccggcactttcaaccagtactgagcccagatctacccggttaaccgaatcgtcaatcagacctttaatttccttcgccgcctgtgcactgcgttgtgctaaattgcgcacttcaccggcaaccacggcaaaaccacggccttgctcacctgcacgggcggcttcaacggcggcattcaatgccaagatattggtctggaaggcgataccgtcgatgacgctggtaatgtcggcaatcttctgcgaactccccgcgatctcgtgcatggtttgcacaacatccgccaccactttcccccctttctgagcggtttctgaggcactcaatgctaattgactcgcctgacgggcgttttcagcgttctgtttcaccgttgcggttaattgctccatgctggcagccgtttcttccaatgatgccgcttgctgttcagtacgggcggataaatcattgttacccgccgcaatttctgacgcaccgctgtagatagcatcagcgcctacacgcacctcgccgacgatagtgaccaattcagattgcatgtgtttcaggctagcagccaacgtgcccacttcgttgcgaccatgaacttcaatattttgcgtcaaatcaccgttggcaatatgtttaatgtgtgcaatcaggtggttgagggggtgaattaagatctgttgcatccccagccagacaaggagcatcatcactaatacgacgaccagtacagtaataaccacgcccatagcaaagctaaaggattgattactgtcctcgaccgccgaatcatacagtccatcattttgcgtcagatagttgttgtaattttgctcaaattcattttggaaactggtggtggggtgattgaagaactcattgattttgttcgtttccatcaaattaatcagttcggttaaggcactaaaatattcctcgtaggactgttttaattttttggcgccttctggatcctgactgctattttgtgggattttttcgtaacgtttgaagcggtcttccgcgacgcttagcgtccctttagccgaagagataaggtccttcaccgtagggccactgccagtatggttaatatccatcatgtaacgaacaccggcacggtttaacgtattgcgtgtttgtaacagatagacccagctttcattcaataccgattgttgctggcgaataacttgtaaaacgttgaagttttcctggtcattctgcaatgatttgaaaaaaagcccgccggataccagttgtaaggcaccaaataatactaataccagcagcaggctggtaaccactttcatacgcttgaacatattaacccttcatcagtacgacaaaacacagacacgtcaaaacacaaagacgtttaattaagtgtgttatcggcactaaaaaggggaactttaccgtggggaggattattttaacggggtgaaaccaagtgttaacatttaccggccaaacattattattgggcgataccggacactgttgtgtttaatgcccggtaggctacccctctctattttgttagccgggtttaaaaagaacgactaattcaatgagaccacaccatagaaagcggccacggcagcagcactcaatagatacacgggcaacatcacgacatctgccgctacggccaccgggtaaagcgccctcttagctgaggtcgtatttttactataaaacttcacttgcaaaggatgttcaaaacggaagatatcggccggtgtagcaccttttctgtgaatagtgccgaccagattattcaggttaatattgcaaatacccgttgtttccgtgaggcttggacaattccaatcagccccttttatcagcggctctattttgcctcgctcttccgccgtctgataacgatatttcagagcgattttccctgtgaagccatcctttttcttattaagattaaagctaccgtccctgactacctcaatcttctttttatcaatctgcccggtaactaatagcgttaagaactcgtcggctcccgatgacaacacataatcgaaatgcgtaccgacaaatgcccagtttttattatcaccctgcttagccaaagacacgccgacaataatatcatcattataatgcgtgtagcctttctcatggccccggatatcatctgaaagctggttagttacgcaagcagaaagaaagaagggtgacatcaatatcgccccccatttacacattaacttcacattacacattaacttcacaaaattaatcacactgactccttgctgtatattgattttcccacatcagtcgatgcacgctccggtaagacaaatggcgattattgcccgctttgtaccacgtccgctgtcggctgatccttgttttactcaatgacttccttcataacgacaaacttctggtagaaccaaccaatcgctaccagacacagccccagaccgaggaatgagaccgaacgatatagcccttcaagaccagacatatcccacaggaacagtttgacgatcgtgagcgccaacaaccccagggaggcgcggcgcactttatagttaggccagtgtattgcgctgtacatcatgccaatggcagttaacatccacgctaaggagtaagagtattgttcgccgctgtacacgatatcattatccaaccggtcaccatgccagagctggcggaccgtcaaggtaatgaacaccattcccagtagcgcaatcgcaccgataacgtagggcttcagacggatatctagccagtgatctggccagtatcttagtgctaccaccatgaacaccatcgggatcgcataggcaacggtcaccatattcagcagcggtaggtcgccaacctgttgtgctgaccagatggggttaaagacaaccaggcagagcaacgttagggtgagcatcagaatggcactggttttagccgccaggcggtatatccgttgtagcgaatctgcaaactgttcacgatagccgtaggccagcgccatcagcccgaaggtcaccccatgcaacgcacaatcggtaagagaagcgaaatccagcgacagatgatagctgccatgcagcaggtgacgtaattcaacgttgatccacaaggccaacagataaatagcattggccgctaaccaattggcggtctgctcaccgcgacgcgcaggtaaccagcgtgaacttagccacaggcagagaatcggaatcccaaaaccgtatagcgtccaaggaataacgaccgaaccaatgtgcaacggcgaggaatatccaaggatatacgggttcattgacaggcgaaccagcagtatgatcgcatgcagtttcaaaatccaagacagtaacgaaacctgtcgccaacgttgccagagtaccaaaactaaaagctgacccgcgagcagcagggttagcgtaacctggctgaaagccataaataatgcaaaggtcaacgtcagttgggcggcgacctgatagatcgtccgcaacagcgctgagccacggcgatacccatcactgaatgcattccacgcgatatacatagccagacaaaccgccagcagtgtgtatttaactggagccagctcaaaattatcgcgacaggcataataggtacttacaacgagatacattggcaccagcaccgacaataacgcccaccacagcttgcggtaaaccggccgggtgacctggtagctaccatatatcccgcagaatagcgctaatgtgctgagcgcaagcagactcgtccagacggtttctggctcaaacagcgttcctgcattaataaagggagaaatggctaatatcgcggccagtggaacaaataaatccaatgaaggtgagcgtctggcaatcagtaacaggctaatacaggagaataccaacgtgctccagaccaggatcgaatgatttgcgcttaacgttaaggctaatagcgaaagcccggcaatcaacccagttaataacggatccagcaaagccgggggccagtttttccagtcattatggcgaaaacgtattttgctttttagcgcccaccccagatgtggccaggctaggaagccgtatgtggttgctagcaggaatagtgaacgcgctaactggtgttcggacgttgctatgaataaagaaaccaaaagccatagatagtttccgaccatcgcccccagccatagccagtgccgatagacacggctcatcaggccgatagacgccaaactaaccaggaacaggtaggccaacagcccggtgacattaccgctgcccgtcgaaacaaataacgggacggtataggcgccaagcagccccaaggccgccataaatggcccctgccacaatgccagcaccatcgccaacagagaaatcaggctgagcaatagcatgagaacgggcatcgggaacatgtcgtagagatatttagccgccagcattgaggcaaatagaccgagaataccggccccactcagcgccgccgggatataaccggcattgaccaagggcaactgaaaacgtgaacgcctgagccactctcccccaacaaccatcagcacactcagcacaatggcggtaccaatccgcaaggttggcccgaacagaccctgttcgctgcctgctttcagcaggaaaatgacacccagtgccatgatcacaccgccgatccacaccatccaacgtgcggcaaactcttgctcgaggcgtttccagaaactctccggtgattttaaggaaaacaggacattttccaattttgtccacacgtctggtttctgtggatgaccactggcagggcctgcatccattttcggcgattcttgaggggcctcatcctgtggcttaagcaccaccagacggtcagcaatcctatattctattggcggggcgggttctttttttactgaatcggcaaaagccttctctttaatctggctttgctttttggtgagtagataattttgataggttgcgtaatcaggggtccataccttggacacggccacttcatctgccaaatgcgttggcgtgctctcttcctcaacagtggccacggtaggttcaggcaagcgtggagcaagctcattgcgcagcctgcctatctcttctcgtatatattttaccgagttggataacgcacttatttgcatatagataacaaacaagaaaataagtaaaaaaattaacagccaatactccattatgtatccaactcagcgtttattaagtaaaaaattctctatgagataaccctatccattcatcggatagcatgaaacagtatctgacaggtatttttcacacgccttaatctaccaattaaatactcgccggcggcagtgtagaaaagttagccagctaacaccaatgggttaaatgtaacagtatgtaagcagtgaaaattcaaaagcaaccgttcatcatattgatacgtaagatatttcctacaaagccaatataagcacacattattaaaggcttttataaacatcataaaaattaaacaaagaatattggaagttcattgagtgaattttcctacaatttatctgtaactatttttttataaatgagatctgaaacaaggctatttcgtcgttgaaaaacgggccaaatggagaacttattattttattgaatcaatcaaggcaagccgcaagagcaggagggccggcctgccctcctgcgcggttgagacggctaaactcaactgcccactgaacaaatatcaaccaacacctgatcctgtcggtgttggattcgtcgaaaccttgttaaggtagaacccggttacggaggacatctcaacccttaaacccatcacaccttagcaacactatcaatcaacgacatctcttcactgctcagcagtttttcgatatcaaccaggatcaacattctttcgccaagcgagcctaaaccggtcagatattctgttgcgagagtaaccgcaaattcaggtgccggacggatctgctcgttggtcaatgacaggacatctgacacaccatcaacgacaatgcccaccacgcgttgaccaaaattcagcacaatcaccacggtattttcgttataagtgacaccttgttgggcgaatttaacccgcagatcaatgataggcacaatgacgccgcgtaagttggtcacacctttaataaacgcaggagtgttagcaatacgagtcacctgatcatagcctcggatctcttgtactttcagaatatcgatgccgtactcttcatcgcccagcgtaaaaatcaggaattcttgtcctaccgtttcgccagccagtttcgtgacggttgctagtcctgccatgttttttacccttcaatcaataggttgaatttatgtttttcaggaccggaaacatatttcaccgccctggatacccgtcatatttaaagtggccggtggtggcttgctgcactcaaattatttagggtattacctgtttttataaggaaaaattcctgtgcgctatgcggtaaccacctcatcagccgcgacgcgtttttcacggtttaaggcctgcaacgctgacacatcaacgattagcgcgacgctaccatcacccaaaatggtggcggcagaaatacccggcactttccgatagttactttccagatttttcacgaccacctgatgctgaccaatcagttggtctaccagcagtgcatagcggcgcccggcactttgtagaatcacaacgatgccttgcgtggcttccgtcttggcatttttaacatcaaagacgcggtacaattcaaccaatggtagaaattcaccgcgaacttgcagcacgcgctcaccaccagctaatggatgtaggtcttcggccaagggttgcagtgactccatcacggcattcaatggcaagataaagacttcattgctgactttaaccgacatgccatcaaggatagccagcgttaatggcagcaggatacggattgaggtacctaaaccggcctgaaaactgacctgtacatggccgcccatttcctggatgttacgtttgaccacatccatcccgacaccacgccctgacacatccgtgacttgttcggcagtagagaatcctggtgcaaaaataagcatcccaacgtcttcatcgctcatgttttcgttgactgccagcccttgagactgtgctttcgccaaaattctctgtcgattcaggccagcaccatcatcaatgacttcgatacaaatatttccgccctgatgttcagctgacagtgtcaggttgcccactggcgatttccccgcagcaatacgagtagccggctcttcaataccgtggtccagactgttgcgcaccaagtgggtcagaggatcgataatgcgctcaatcaaactcttatccagttctgtcgaactgcctaacagcgtcaattcaacttgtttgttgagcttgctggctaaatcacggaccaaacgtgggaagcggctaaatacatactccattggcatcatccggatagacatgacggattcttgcaaatcgcgggcgttacgttccaactgccccatgctattcagtaaatcaccgttgatcaccggatccagcgaacttgagcgctgagcgagcattgattgggtaataaccaattcgccgaccaggttaatcagctggtccactttttctaccgctacacggatactggtcgattcactggctttcgctttaggcctgacctgttctgcgttagttggtgcagcatgcacatcagctttcagcgtgctttggacttcaacggcaggtgttgcggcaggtgttgccaccggctgaaccgattctgcgatcaccgatgcctcggttattgctggctcaaacaagcgttctggctcagatgattgttctgattcaacggtctgctcagcataaatctgctctgtgtcctctgcggacacaaagctaatctgctcaggttccagaacaaagcacaataccgcgctaatatcctcttcactgacggaggttattaaggtggcctcaaggctatcagcgccctgatggggatcttgcacctcgcccagattacccagttcctccagcatcagagagatttctggcgctttcaggccagacaaacgaatacgcatcccgccttgaagcaacgcgggtgatgtgttgccagcgagagaagatgatacgcgggtggaagccgttgcttgcgtattggcggccgtactgtgctgatcggtagcggattgattttcggttgtaggttgatcttcggttgtaggttgatctaaagcatcaagtgccaattggcgcaacgcctgacaaatgtactcaaagctttccgaatgaggttcctgagaggttttgtaggcgtccaactgttcctgcataatatctttcgtttccaaaaacaggttgatgatctcagtgctcaagcgcatctcgtcgcggcgagcaccatccaacaggttttccaatagatgagttgtctcttgcaataccgtaaaaccaaaagtagcggcaccgcccttgatcgaatgtgcagcacggaaaatagcattaagctgttcattgtcaggtgtcagcgggtccagcaataacaaatgctgttccatatctgccaacagttcatctgcttcatcaaaaaacgtctgataaaacgcggtaatatccatgctcacggtgtcacctctactgtgcgtcgcggcttgtcggagagaccggtatattgcttgcaggtgctgcgggtaacgatgtcgttggcccattggcagttgaagtaatattccctgtactcgattgttgtgtttcagttgtactcatcggctgcggctgcgtgttcaccggttcagccgctggcagtgctaccgtgcctggcaatgtgacatctgatggcagtactcctgctgacgacagtgctacggccgatgcttgtgttgtcgtagctgatcgtgttgtcgtaactgcttgtgttgtcgcagtggcttgtattgtcgtagctgatcgtattgtcgtagctgattgtgttgtcaccgatgatggtattaccgccggtgagggtattgccgccgatgatggtgttattgccgatgatggtgttactgccgctacaggcaccgtcccgtgagtatcaatctgctttaagccggttgctttttctatatccagcgctctattgtctaaattctcgtgctcaatatcgtgttgagactgcttattcagcactaaaatactgatacggcggttaaccggatcatctgatgcctgctctttcaaccgcatggttgacgccataccgactacacgcagaattttgccttcatccaaaccaccagccagtaattcacgccgcgaggcattggcgcgatcagccgataactcccagttgctgtaacctctttcaccgcgggcatacggtagatcatcggtgtgaccggataaactgagtttattcggtatgtcattcaggatcggcgcaatagcacgtaaaatatcacgcatatacggttctacttgcgcgctccccatcttgaacattggccgattttggctatcaataatctggatcctcaagccctcatccatcatgttaatcagcaaatggggacgtaatgccttcaaccgggggtcagactcaatcaattgatccagtttttcccgcaatttattgagccggtgtatctcttgcctgctttcttcggaattaatctgctttctcacttcacccacttgttgagtaggatcatcaccaccaccgggaatagggctagtactggaactgcttttatcaccgctggttaaggcgacttttagtggtgtccgaaaatattcggcaatttgcgtcagttcttgcgggctagaaacagccagcaaccacatcaccagaaaaaaggccatcattgctgtcataaagtcagcgtaagcgattttccatgacccaccgtaatgcgcagcaccatgcttagttttgcgctttttgaccagaataacggggtggttctgatgcttcatgcgtcctcttccgtcgcttgcgatgccggtgctttcactcggcgcacatgctcttccagctcaataaaggatggacgctccgtggtatagagcgttttacgaccaaactctaccgcgatctgcggtgcatagccgttcaagctggacagcagagtcactttgatgcattgcatcattttggtcgtttctgcgctttgctggcgtaataaggttgccaagggggaaataaatccatacgccaacaaaataccgaggaacgtacccaccatggcatgagcgatcagggcaccaagctccgcggctggccggtcagcggaagccaaggcatgtaccacgcccatgacggcagcaacgataccaaatgccggtaacgaatcccccaccatcgccagactaccggcaggcacctcagactcttgctcgtgcgtttcaatctcttcatccatcaacgcttcaatttcaaaagcgttcatatttccactcacaatgagccgtaaataatcggtaataaattcgactaatgtcttatcggccataatccgtggataattagagaaaatttcactttccaacggattttctatgtccctttccaacgacagcattccctgttggcgtgatttcgccaataagcggtaaagtaacgccattaaatccatataaagggctttgttatatttagaacggcgcatcagcttcggcatcgcacgcattgtggcttttattgctttaccgttatttcccacaataaatgcgccaatacccgcgccagcgataatcaaaaattccgctggctgatagagtgcacccaaatggccaccgacgagcatatagccaccgaaaaccgcacctaagaccacgagataacccaaaataactaacacgcgacatccttagcaaagtgtgtgggtggaaggtgaggcgttaacactctttgagggccataaaatgtcattgacggtcaacagaaacggtctccataccgctgctgtaacctatcccctgctaacttgacgttacagtgatgttagcaacctatctgtaacgccaataattttgggcatgaatgtctgacaattttatgaaactcaaactgcgcgtctaacctgctcatccagcagttgtgaagttatatcggcagactgcggagaaagtttacgtttttttactgcgcgggaaggaggctggcaaagactgcagacaaactgtttagtggttgatgggcatgggtgataaatgtccccccacagcaattgcatctggaaagctgcaacatgccactgtcaacgaaacggaccagcgtccaggctcgggtcaacgccagtaatggcgggacttcaggcagatcgggacactgttcgaggtaaagccgatacgctctaatcaccgcttcaacacccgtgcaatagccacttttaagcaagaaactgtaagcgttataaaacatcgacgaatgaatattctgttcccaagtcataaaccaatcggtcgaaaacggcaacatccctttagggggagggctgcctctaagctctttgtagagcttgattaaacggcctcggctaagctgtgtttcactttcaagcatctgtagacgagcacccaacgtgatcagttccattgccaaatgtatgtctttagcttcctggacaatacttttctcaaccatcaatcatgctctttttttaggcgtactatcgtcttttaacgatagctcgtggagtaagtgactcgacaagagaattccggtatggatttgttgcaggtcatccacgcgagactctttcgttagatgatggatcgtgttgtggtcactaaaacggaagtgacaaactaattggttagtttcagctaatttaaccatttgcggtaacgttaactgtgataatgcatccgccatggtatccgtaatacctaagcgaaacatcgccgacgctttttcatcattaattaaccgttgagctaaaagtaaatatgacaaattaatatcataaatatgtttgagtaattcagacgtactcatcttacacatcccaactgattatgttttaaaacataaattgaatgacaaaatttatcactcaaaaccagggatccttcccgttatattgttaattagaccttacagaccctaattactttacgttacagggggtaaccaccttttctcactgtctcacccgagttactgacatgagccactttacaaaattcgctcatttgcttcactgcctcagcgccaacgactttggacagagcagaaaaggtaattaaaacttactaatgtaacatgacaaaaaaatcaccattctggtatgaagcagcacatcaaaagcctagctgctgaatgttacactgctttgatcttgccttttttatatgaactatttcttacaaaatgttaggaatattcctaaagaggaccaactctactcccgaatcgttagcacatacaatgtgagtagctatttattttaaatgtaatgtgatacaaatcacaaaaataaaatataagtctatttttttgcattttttctgatcaattatcactcacatgtacacctttaaaaatttaaaaagtaaaaaaggagctaaaaaaccctaaatattagcctaatttttatcatttttagatcaattcgaataaaaacatccccaaactgaaatatcagagcaaatatatgttataagctaacattatcaatattaagcgctgaacttagatttcattactcgtcttctttaaccaaaaacgccataaaattattttttaatgaatatttatgctgaacagaaagattttacagttggtcatttattcatccctcactgatttaacataaaaagaaatgtcagcctgtattaaaagtaacaatagaggtaacggtatatttcactctttatcgccacctcgaacacgccgttagcactggctgatatctgcattcttgtaagaaaaccaccatttaatcataaattaaattaactaatttcattaataatatgcatcacaagatttgctgaccaacgctgtacactcgttaactcactactgtcactgcctttttacgtcactacaaataaatgcgacaaatatctcatttttgaaaggtgtcatcccctaatcttttaaatacacacactattccagggcagccccccccggaatagtgtcttgagatcaaccaggctatttgaaaccttgccccctcaaagccattcgccgaaacggcggatatagaaccgcttcatcagttgcgcaacaacacagtagcaaatcagtgtacccgctaaccaagggaaatattgccatggtagcggctctaaccccactaatgtgcctaatggtgagaaaggaatatagatcccgatggccataattagacctgtggtcaataacaccggtaatgcagcagtactttgaataaacggaattttttgcgtacgcaacatatgtacgacgagagtttgcgacaataacccttcaataaaccaccctgactggaacagtgcctgatgttcaacactgttcgcggcgaaaacaaaccacatcaacgcataggttgtaatatcaaaaattgatgatgttggcccaacccataacataaagcggccaatattcttggcatcccacttacgcggtttacgtaaaaactctttgtccatcttatcccacggcaaagagagctgagaaatgtcatacatcaagttttgtaatagcaaatggatagccagcatgggtaaaaacggaataaatgcgctggccactaataccgaaaacacattaccaaagttagaactggcggtcatattcaagtatttgatgatatttccgaaagtttcacgccctttaatcaccccggcttccagtaccatcaagtctttttccagcaggataatatcggctgactctttagcaatatcggtcccagtatccactgaaatgcccacatcggcatcacgtaatgccggtgcatcattgatcccatcgcccaagaagcccacggtatgtccgttgctttgtagcatttttagcacacgtgatttttgtaacggtgtgagtttggtaaataccgtgcgtaattccacttcccgcgccaacgtagcctcatccattgcttcgatatcacgcccattcagtggttccccaggttccagcccaacatcccggcaaatttttgcggtaataattggattatcgccagttaatactttgacggcgacaccattctcccgcaatgcggcaatcgccgccgctgcactttccttcggtgggtcaagaaatgtcagtaacccctgcaccactaaatctcgttcatcgtcaatattcaacggcacagggctgacctgagcccctaactctcgggtcgccagcaacaagacacgaaaaccatcttcattatattgcgtagccagagcctgtagcgttgcacggcgggcagcatccagtggaaagatgtcatcaccttcccgcacatgagtgcagatactgagcatctcctccaccgcacctttgcaaattaggtgctgttgttgttgcgcatcttttaccacgatggacaaacgccgacggataaaatcgaacggtaactcatccactttattgaagttgcgcaacgcctctatttctggcttgccacgactaaatttgattaccgcctgatccatcaggttgcgcattccactttgatggaagctgttaagccatgccagctgcaataccttattgtcgttacaaccactaacatctaagtggtgctccagaatgatacgatcttgggttaaggtgccggtcttatcggtacatagcacatccatcgcgccaaaattctgtatcgcattcaaacgcttaaccacgactttacgccgggccatcgcgatggccccttttgccagattagaactgacaatcattggcaacatttctggcgttaaacccacagcaaccgccaaggcaaacaatgcggcttccgtccaatcgcccttggtaaagccattgatcaacaagacaatgggcaccataaccaacataaagcgaattaataaccaactgacgctattgacaccacgatcaaaggctgtttgcgcgcgagtccccacaatagatttagccagtgaaccaaagtaagtatgcccccccgtggcgaccaccacccccattgccgtaccgctggccacgtttgtccccatcagacatatattagagagttcaagcagttccccctcactgccggcccccgcatccacggattttgagctgacacaacccatcgcatcatacttttcgaccggaatcgcttcaccggtgaggatcgcctggctgacaaataaatcacgtgaattaatcaggcgtaaatcggcagggatcatatcacccgcagacaacagaataatatcgcctggaaccaactgattaattggaatttcttgctgagttggtttagcaccatagtggccgcgacgcagtaccgtcgcggtggtacgcaccatcgatttcagtgcttcggccgccttattcgtccgatattcttgccagaatcgcaataagccactgatcagcaccattgtcacaataatgctcaccccgataagatcagtttcccccccctcttgcaatggcagccaataatcggtaaagaaactgatagacgccaaaataattaaaacaaaaataaacgggttattaaatgcggccaataactgaagaaaagccggtggcgctttttcatgcgcaacctgattaacaccgtataattccagccgctctctggcatcctcttccgtcaaaccatttaaatgcgtatttaacttgaataatgtttgttcgagactattttttgcttccagtgcaatagcaaaaggtttcttattattactacggtttgtatctgttttttctaatttacgcataacgcttctcttttaattcaaaacgcacgaagcttatccgctcaatatccccgtagttcttcaagatacagaagtgttagctagcctttcttaccccagtcactgagttatttaagatcttggggatttactcggttaccgcctacctgtatctcgaagtaaatggggtctgattgagagatatgggtgccgaattatgtcattgcgttaccaattttaaatttaattagcaacagtcgattaagttaactctggggtgttcatccataacaactccttactgcccaacggggcagcgtatatgacttaatgagacactaaataataaatccattatttaattaacttatcgttttatctatttatcgttttatctatttatcattttatcgcttaattaatgactcgtcaggccggtaattcagatgcaatgcgccaacgtatggcactgacactacgttccaaacttacgcggcagacaatattttcaatttctttttgtgccgctggcgatgccactatttctgcgcagacttctaactgaccagatcgggcaatatcagcactgcataacgactgcaagtgcaacgccatcccatttaatgcctgcaaaatcagtgtgcgaaccagtatttcatcttcagctccgcaagtgatcagaatacgataacggacatctaaatctatcgcctgctgttgaggctgcaaattaatacgttgtgctgcttcacgtaataagatgttggcacacagaataaccgcagttgcgaagacagcattccagtacaaacccagaccacaaagcacaccaatgcccgccgaacaccacagcgtggccgccgtattcagaccgcggatattcatgccttcacgcataatgacacccgcgccaaggaaaccaattcccgaaacaatctgtgcggcaatacgcccagggctatctggtgatgtagcataagaactgagaataaatacggcagctcccgtggcgactaacgcattagtgcgtagacctgccatacgctgacgccattgtctttcggcaccaattaatgcaccgaggcacattgccagtaataaattcataacaaaaggagttaatgacatgattctctccatgaaataatcattggtagaataatcatgtgctatttataccctaaataattcgagttacagtcaggcgacaaacttgaaatatgacggtatatacccacgctactttaagatgcaggtaggcagataacacccctgcatcttgaagggcgacgggcatagcacacaggtaatagtgctgatagatatacccagtttatgaagtggcggccagaatactgacaaagcaacaacttcatagacaaaaagtataattcagcaataaccggtgttagtgcctggaggaaagagtgcgtggctgttaaattccataataaaaatccaaattaataccctcgacatttaccgtcgagttaacactttatttggggatgcacagctcaaagatataccgagagggtgctgcccgccgttttcggcaagcaacaaatcaatagagagattggttagcttgccttgcttatttgacttgtactttgcgtatccattagtttctccatcgtgattttccgaaagtataattgcgggtgataactatgtaaaggctatattcttaaacaatacttaaaccaaacaaaggatgaccaaataatagtgtttagcataaagagtactcttcattatttaatgccaaattatttctctcaatccggcgttatctgcactgcctgattcaacagacctcgataacgacataacatcacgtttgactacatgacatcacgcttggacagcattaaatctcattatcatttcccttgtatggaacagtaaacaatgagttgatgacaactttatatggatgccatgactgctgattatctccgtaacgctttcgccctaaacctaccgtgaacgttgctactaaaaaccggagggactacatagccactccacatcgtagccaacgccttgaccttattataaataacctaatagatctttgttttaagttgcgaccgtgatctcatttatacccctaattattttagagttattgccgataggttcttagagcaatgttgggataatttcagatatctcccctaaataattcgtagcgatgcctattaggcaaggcccctccctcaagcaactataaaaacggaactaaaaatgaaacgtggaagtgcgcacaagccattggatatgaaaatagcaccagagccgaataaagataccaaagtgtcctttatcaataatatgcgtctggtcactttgtttatcgtcatattggcgggaatattgcttttatttgccgccgctattgggacatcgggctactttttaaaacaaagtaaccaatctttggcgcaagcgacgcaagagatcgacatccgtcagggtctgtctaacagctctaatcatctacgaaccgcccgtcttattctgatccaggccgcctcctccgcacgtattggtgatgctacaggctatcagcaaggcctaaaaaatgcagaaggccgcatagctcagtcacagcaaatgttcgacctctattataaccggccaacaaaatctgaaacggacatggcgctggatgtaccactgaaaaaagcctacgaacaatatcgtgacgatgggatgaaacccatgttagcggcaacgaaagagggccactttgaagaggttatctctcttgatgctgagaaaatcagtctgctagacgacggctataacgaaccactgctgaaagccgttaaatatcgtacagagcaagcgaaccagattaaccagtccgctcaccaagaagcgcgccttggttacattctcatggcgggggcttttgtcttggttatcttattgacaatgattgctttcttagtcatcagtaaggtaatcatcaatccaattaattggttggtcacccgtattcagcggattgcccagggggatttgacgcaatctcccgtctcatttggccgtaatgaaattggcgtactgggaagtaatatccagcaaatgcaggatgcattagccatcacagttgaagcggtgcgcagcagtgctgaatctatctatcaaggatccagcgaaatcgccttggggaatactgacctttcagcacgcacagagcagcaagccgcttcacttgaacaaactgcggccagcatggagcaactgaccgcaaccgtgaaacagaatgctgaaaacgcccatcacgcgagccaactggccgcgaatgcatcgggtaaagcagctcaaggtggtgatattgtcagtgatgttgtcagcaccatggataaaatatctctcagctccatgaaaattgctgaaataacgaatgttattaatagcattgcgttccaaactaatattttggcactgaacgcggcggtagaagccgcgcgcgcgggcgaacaagggcgcggttttgctgtagtggccagtgaagtacgccacctggcgcagcgcagcgcagatgccgcaaaagaaattgagtcgctgattgaagcctcagttgatttaattggtgacggttcaattctggtttcaaatgcgggtaaaacaatgaacgagattgtcacagcagtcactcacgtcactgatatcatgggtgaaattgcatcagcttccgacgagcaaagccgcggcatcagccaggttgcgcaagccgtatctgaaatggataacgttactcagcagaacgcctctttagtgcaggaagcctccgcagcggcagcctctctggagcaacaagctgaaatattgactcaagcggtcgcggtcttccagcttgcgggtcactcgtctatcaaggaatttaaaagccctgtctcccctcctacaggccaaaatggttctggcatcaataagaagccaacggatggttcactgaattgggaaactttctaagcaagcaatctttgttggccatttcagatgcagcttattcatctaagtgatgccgggaagtgagtggccgcttaaaataccagggaagataaaaagcaaaaaccggaggataaggtatgaaccttcctccggttttttatcgcaatacaaacgagcctaaggaaaaacagtggcagcgtaacctactgagaaagtggctccacaaaggtgccatcttggctatccacttcattaaagaaccagacaccggccggataatccgccaaagagaccagatacatcaccccctcactgaactcttccacctctaaaacaaccccttcacggcgtgggccaccatcagttttgactgtcactcgatcattaactttcatgctattacccttagttaaatcaatgcggctagtgtagtacaaaatgaggggcgaatgataaggtttacggcagacccgcctgtgattggcggtgaggttacgttgtaacggattgtgctttattacagatggggattttattacagaagggactttattacagacagtaaaaaacccgccttagcgggtttttttataatcagccaaaggccaattagattgcagttacgtttgctgcagacggacctttagcaccgttctcgatagagaactgtacattctggccttcagccagggtcttgaagccttgatcttggatagcagagaagtgaacgaacacgtctttgctgccatcagctggagtgatgaaaccgaagcctttagactcgttgaaccactttacttgacctttcatcatgttagacatgtgtatttcctttattaaaaaattttgccgccatgggcgtgttatagccggttatcagtcgttacttatggaggcactatgaaggaaattcgtcagtgaagagctatcaacgataacgctttaaatatgaaccactttactcaagatgtcgtgcataaataggtctgtaccacaggccgagacgcattaactcatgagcgagtattaatagcaactctttttagtaaccaaactgaatattcttgtttatatgcctaaaataaaaccaaaggagtcaattaatgtacttttccccttatcttcatacggcataatcctctaaattgttatctcttcgtagtgcgccctgcggtttttggcctctcatagttgacatgtgcgacagatcacattctgggcatcttgtttacagagaggcgctgaaagtttatctattgagtttgctatgatgagttgccaccgaaaatccagcccattcaggcttatcactgacccaaataaaatcgtctcctcagacataacaaaaataaggctgacaccatgacgtcacaggaaaaggtaccattccaggtgcaactgagtcttccccagattttgtcccgccgagattgggaaaacccgcagatcacacagtatcatcgcctggaggcccacccgccttttcacagttggcgtgatgtagaatctgcccagaaggatcgtccttcaccacagcaacaaacactcaatgggctatggtcattcagctatttcacacaacctgaagcggtacccgagcactgggtgaggtgcgatttagccgaggcaaagccgctccctgtaccggctaactggcaacttcatggttatgacgcaccaatttacaccaatatacaataccctattcccgtcaacccaccacgggtcccggatctaaatccaacgggttgctattcccgtgatttcacgttagagccaagctggttggcatcgggtaagactcgcattatttttgacggtgtcagttctgcattttatctgtggtgtaatgggcaatgggtaggttattcacaagacagccgcctacctgctgagttcgatctcaccccctatttgcaggctggcagtaaccgtatcgcagttttagttctgcgctggagtgatgggagttatcttgaagatcaagatatgtggcgtatgagcggaatttttcgtgatgtgaaattgttgcataaacccgagattcacttacgggatatccacatcatgacgcatctatcccctgaattcacctctgcaaatttagaggtaatggcggccgtcaatatcccctctctacagctcaatgatccgcaggtgaccggatcctatcagctccgtgtacaactttggttagccgataaattggtcgccagtttacaacagcctttaggcacccaagccattgatgaacgaggtccttatactgatcgtacccagctagtattgcgaatagatcagcctctgctctggagtgccgagcagccgacgctataccgagccgtggtttccttgctcaatcatcagcaagaattgattgaggccgaagcctatgacgtgggtttcaggcaagtggcaatccatcaaggcttgcttaaaatcaatggcaaagcggtgctgatcagaggggtgaatcgacatgaacatcacccgcaaacaggtcaggccattgatgaagagagtctgttgcaagacattttattaatgaaacagcataattttaatgctgtgcgctgctcccactatcccaatcatcctttatggtaccgcctttgtgaccgctatggtttgtatgtggttgatgaagcgaatattgagacacacggtatgcagcccatgagcaggctgtccgatgacccaagctggttttcagctttcagtgaacgggtgacgcggatggttcagcgagatcgcaaccatccatgcattattatctggtcactgggcaatgaatcaggccatggcgcaacccatgatgccctctatcgttggataaaaaccaatgaccccacccgccctgtgcaatatgaagggggcggtgccaacaccttagcgaccgacattctgtgtccgatgtatgcccgtgttgatgaagaccagccctttcctgccgtccccaagtggtcaatcaaaaaatggattggcttaccgaatgaatctcgccccttgatcctatgtgaatacgcccatgcgatgggcaatagcttcggtggatttgcccgctattggcaggcatttcgtcagtacccgcgcttacagggcgggtttatttgggactgggtagaccaaagtctgactcatcataatgaccatggtcagccttattgggcgtatgggggtgattttggtgatactcccaatgaccgccagttctgcatgaacggattagtcttccctgaccgcagcccgcacccgagcctttatgaagcgcagtgcgcacagcaattcttccaattttcgttgctgagtacgaccccgttggtgatcaacattaccagtgaatatttgttccgagagagtgataacgaacaattatattggcggataatgttagagggagaatccgtgttggagggtagccaacccctgaatttgtcgcctgaaagctcacagtgctacaggttggcagagaaattacccacgcttaataaacctgggcagctatggctgaatgttgagataaggcaaccaaaagaaaccccgtggtcccctgctcaacatcgcagtgcctggcatcaatggcgcttaccacaaccactcttttcgccgtccagtgatctgaccaatgctacagcgcattatgcccctcaactgcaacataaccttcaactacaacataaccgtcaactacaacatgaccttcaactgcagcaagatgaacagcatattaaggtgacttatcagcaacaatgctggcaattcagtcgtcaaacggggcggttggatcaatggtgggtggcggataaaccgatgctactgcgcccactacaagatcaatttgtgcgtgcgccgctggataacgatatcggtatcagcgaagctacgcatattgaccccaatgcttgggttgagcgctggaagaaagccggaatgtatcaactccagcaacgctgcctctctctacacgtagatcatttatcccattcagtacaaatcagtgccgaatacggttatgaattcgagcaagagcccttgctacacagccattgggtataccgttttgaccgacatggccgtatgaccattgatgttaacgtccgtatcgctacctcactccctgcgccagccagaattggcatgtgttgccaactggctgatatctcacctacggttgaatggctagggttggggccacatgaaaactaccctgatcggcagcttgcagcacaatatgggcactggtccctgccattagagcagatgcacaccgcgtatattttccccagtgagaatggcttgcgctgcaatacccatacgctgaattatggccgctggacgttaacgggcgatttccactttggtataagtcgctacagcacccagcaactgatggtgacctcccatcaacatctattggaacccgaagagggcacctggctcaatattgatggtttccatatgggggtgggcggtgatgattcatggagcccgagtgttcacattgatgacatactcacccgtgaaacctatcagtaccaaatctgttggcaatacaaggtgtaaggcatcggtgggggggcagaggcaaggatgagtcatgccgacaccagcccccccgcagtttcggattaatacctatatcggcactaaattaatgtttatacaataaccaagctccaaacatctcttaatttctgttgtcacgatgcaagtaggccatacatgcattgctcctttgcaaaatttacgcgctcatcctatgggcgctttttttgttcctttatcccctctttcgctgcctttatcctctctttcactgatagttacgcacgttcactctatgaattttttccattacacgactaagatacccttttagccattatcatcttgagtcactaccacttactatcatctttggccacagccatcattgctgactcaccgccacgccattaagaggaatattatgacattgttaactcatctccctgcaaacatggtcgcgattgaaatcccccagtttggtggaccagaggtattagtcccagccaaacggccaacccccatgccagccgctggcgaaattttggtgaaagtatctgccgctggagtgaatcggcctgatgtcatgcaacgtcgtgggcaatatgcgcccccaccgggtgcctcagatattcccggattagaagttgccggcgaagtggtcgccattgccgcggatgtcacgcgttttaaaattggggacaacgtctgcgggctgatcgcgggcggcggttatgcgcagtactgtgtcatacatgaaaccaatgcgttaccgatccctcaggggcttagcgccattgaagccgccgcacttcctgaaacattctttactgtctggaccaatttattccaacgtggtcacttcactgcaggcgaaaccgtactcattcatggcggttcttcaggcatagggacaacagctattttgctgagcaaagcttttggcgcggcaacggttattgtgacggtaggttcggaagagaaacgtcaggcgtgcctgaatctgggcgcagatattgctattaattatcacactcaggattttgtcgctgaaaccaagcgggcaaccgccggtaaaggggcagatgtgattgtcgatttaattgctggtgattatgtcgcacgcaattatgacgcagcggcgatgaatggccgtattgttcagattggtacacaaaatggtcatgccaaagaccttaacctgatgctgatgttaataaaacgtctaacacataccggctccacactgcgctcccgtacagttgcagagaaagcattaattgccaacgaacttgaacaacacgtttggccactgctgagtgagggtaaaatgaaaccacagattttcagtaccttcccgctggaagccgccgcaaaagcccatgaactaatggaaagcagtacacacataggtaaaattgttctcaccgcttgagccataaatgcctattatcagcaggatgcgatacccaaaataattcaagatgcaggtagtcagcaaccgagcaatccccaggagcttagataactcagtgactggggtgagcaagggcaactaacccccttcatcttgaagggcgacgggtataaagggtatataacagttttactggctaatttatcgaactgatatgctttagcattaagctttcatgctaatatataacaaactgtaatggtttaatttcaataagtcattaatcacaaggttataattatggacataattaaaaaaatattaattgacgacatcgccagaataaacaaaaaagaaaaaagagatggtcggttaaaatttaacagtgattttgtccacaaacatccttatctctgtctggcgatgttagtgtcatacgtctttgttttggttttgatgtacttaacgccttactttggtactggctatatgatcgcctttactgttttttttgttgtcatgtcagcgattttaatgatggaaatcaagccggtatttaagtttgaagatatcggtgttcttgacttgcgggtgtgttacaacggtgaatggttctttagccgcgcattatcaacccaggcaattgacgaaatattgaacaataaaaatatcagtgatgactttaaactccgtttcaaacatatcattagtaacaaaggcgaaatagatttctatgatgtttacgatttagcctatatgcaaaaaaaaccaattcaactcaatgatctgaaaaccacgccgtccctggtcagcaataccattattagtccataaacatgattattaggccataaacgcatccaaacactatcgctagcggtcatcctggcgatagtcaatgcactcatcttcaatataccaatgttcaatatgccaatggacaatatgccaatggacaatatgccaatggacaatgcgccaatgcgccaatggtcagtacgctttgtaccgccaggctccttaactcttctcagcatgttatatcccctactgattacctcttttgatggcatgtaaaacacctattttattgataccgccttcttttattgataccgccttcttgcttgcggttggccccaccctaaccactgagactgctcccaactttgggtctactcaccgaggttaccgcagcttatcttgttgtcgcgccagtcacgtagaaatataaacattacaatataagaaatgtatttttatcaattagagatataaaaaatgttaggtggctatcggtaataactttaaacctacctataatccattgatacatctaagaataagaggcagtaactatggacaaaattgacgaacaattgattgccattttagtcgaaaatgcacggacctccctgaaagacctgtcccagaaagtcaacttatcttccccgagcacctctgaacgtctacggcgtctcgaagagcagaatatcattcttaactacacattaggtttggaccaaaaagcctttggttataacttacaagctattgtccgcgtcaaacctgtcgccaacatgctggatgctgttgagaaaatgatcaaggacacgccagagtgcatagagtgtgacaaaataaccggtgatgactgttttttgagccgtttgtccattcggtcaatgggacaactggataccattgttgatcgctggtcagagcaagcagaaacctatacctcgatagtcaaaaccaccccgattacacggcgatttccaccattagttcgaccgataaaaatataaaaagcggaagtgagcatctcaagcctcacgttacctataataaagggttattattgacagaattatattgatatttaggagcagatctttgatgtgtattgataaaccagagtcagatccgctgatccttacacttcctaacacgcgctgggaccagaatgcagaggataataccggtgccattgaggcacttgagcaaggtaaagtcctgttcttacctcacctgacttttgaactgagtgagcaggaaaaacagttactggaccctaccctggttgatgttaaacgcaagaatatcagtttcaaaccgttagaaggtgtattaactggcgtgactgatgcaagcaaaatcgcattaacccgccagttattggatcgttattatcaaagttgcctcagtttggtacagcaactcctcccggtctatacgcatgcgctacacagcccgaccaatagcttgagattacaccctgtgaccgcctggcgcgacagtacgtcatggcgtaaagatgatagccgcttacatgtagatgctttcccgtcacgcccaaactacggtgagcgtatcatccgcatattcaccaatattaacccgcatggtgaagcgcgttcctggcgtgtcggtgaagattttacacaacttgccagccgctatttgccacaactggatagctattcatcgctcagcagttggttgcaacataaaatcggtatcaccaagcgcccccgtagccattacgaccatctgatgctccaactgcatgacaaaatgaaggccgatctcgcttatcaaaaagatggcttacaacaggcgattgagttcccaccaggcagcagttggatatgcttttcggatcaaacacctcatgcggcgatgggcggacaatttatgttggagcaaacgttcctactacctgttgaaggaatgaaatcctcccagcgctcaccactgaaaatactggaagcgttgacacaaaaaacgctgatataagtggccacatagcgtctaactccctcactaaccctatgggggagttaatagactaaggctcacgcgcctgcctgatatacaccgccaactaatcataaaaaaagtgcttattcgacttgatcccacagaaaaaaataaatatcatttttccgtactgaagcggaaccgattatagtgagaacagccaaaggtttatttcatcaagcgtatcccacgtaaggagatgctttaagatatagatcttaagcgtgtatccctacgtgtacagttattaggccctatcagataaagtggaggctaatatggtcaaagtctatgatagaaatagaaaccaaattgtcccagggcaacgcgtgatgatcgcacaatctggggtgattgatgtggcaaaagccattcatgctgacggaatgtctgccgtacaagcagagcgggagaaggttgtcgagttactgcataccggtgaacgccacgttccttttgatttagtgagactaggtttataagcatatcattttaatttcatcacattagcctaggcttatagccaccgattaaaacagcgatttccgattaaccgcagtacgctttcctgccggtatttatttgccgggtttggcctgccttttattgggccacccggttttttttatgacagcttttttatgacatcctttttatagcagattgcacggcaataataatatcaactgtaattacctgaatacgacccgccgtaataataagatgccatcatatgtaatccggttggtgttaatgccaaccagataatatccatttagatgtggcaggcaggttcaattaccttagccactttcttttggaatgtatcaagctcgcaaagcttatcgtcaccgttattttcacaaccagcaactgcaacggaaataatacccgctgggttatttttcagatccaatttttcggcattacgcaactgatccatcgtttggtagaacatcttcaccgcaacgtagcgctggtggttatccggattttgccatagttcaaaaaccaatcccccacctggtggagtattatcaggttgctcgggtagctgccagtcggctcccagcatacccgcaatattggcaatattggtatcatgcccaccgaggaacaagacccggttttgggctgaaatgggtagcttttgcccctgagcatccagttgaagggttaaagccgtatctatctgctgtaataatggcgtccctttatgacgggcgatatacggtgtttttgccattaaattaaattgcgcgttatgtaatgacaataaggatacccaattctccgccccttttagccgttgccaggcaacctctggcatggcttgtgcgttttgtaataagaagatttcacccaatgtcgatgataacgccagtggcccactgagggtcacttttgtcccttctttattaacgttaacttcattggccgcaaagtgggcaaaatcacacgtttttccttgctgttgcaaagatttgcaataaggagaagccgcaaaattcagcacgtcccccatctgggcaaaaggtttagcgtagcgctggctcaccgtatctaacggcccgcccaactgttcttcaatcgctttatctgtttgtgcggcgtctaacttacacacgccagcctctaccggatggaacaggggatcggtctttttcaaatcggcctgattatgcacggtcaaaccacaccccggagccacaccatcaagaaatgcctgtccggttaagcgggtacgttgatcgatatctgcctgtgcatataccaccccctctgccggacatcccgccgctaacaaaccaaggctgcgaaagtaatcaccataaaacccccccatcaatgtgaccaactccgcaccacgtggcgttaaataccccgcttttaccggccattgtggccacttatctggcgtaacatcattcataagctgcgtttgtttggtcggcgagcgaacaccatggcgactcaaaataaccacacgttctaaagtatagcccgatggctcggcggctaccggcgcagtaatagcagccaatccgcttagcatcaataccagcccagatagccgtacacgattttctaatactgacatgattctatatccttattaaaactgcgaatattttgacttcatcgagtatggtttacgatcgtctggctaacaatgtagaagcacaataagattgatataacatttcccacgggccaagcgtctcagacaattcagcctcgcggtatgggctggcgtagacaagcagggaataatttatataatcaggtcaaataaataaaaaggtctgattatgtcatttactgaatgggtaatactgggtgttgttttgggttgtgtgattggcgcgctgctgaaaatttttggtaaaaaaaaggaccgctaacctcaggctgcggataaataaatgcagatgaaggggaaacctgccgttggggccgtagatttaaggtaccaatggcgtaagccaccgaagcgcgcttgcccgatagttggcaaaacggtatctggtgcggtacccccttcaagcaccgcgctataaaacaggttggccatcttctgttggcgctggcacaaccagaatatgaggccaaagacgataaatcacgacggtcatactgaccgctgctgccgttgttccataatccgatgcaagtttgtctccaaccacaccgtcagcccttccacctgctcttggatctcttttcctaacggagtgaggctgtattccacgtgaggtggcactaccggataagcagtcctgtcaataaaaccatcttcttcaagatgctggagcgtttgtgccaacattttctcactgactccaccaatctttcgtctcaatgcactaaaacgcagtgtttcattactcaaagcgatcaagaccaacaccccccagcggctggtcactcgcttgagtatctctcttgacgggcaatcgacattaagcagttcaccgcgcctgagttgttccggaaatgaaatgttgccattcatattttgtagttttgtcactctcacactaaccttttggtatgtacttacgtaaagtgagtatattgcatatgatggctttaaggatgattttgggcagatatatccaaaatagtcttctctgagcgtcaactgctcttcttctaaatatggagcgtcattatgatcgcagtcaccggtgccaccggccaattaggccgcctcgttattaacgtattattaaaaaaagtgcccgcccacgacatcattgcggcagtccgtagccctgataaagccaaggatcttatggcgttaggggtgcaagtgcgtcaagccgattataatcaaccaacaacgctggatagtgcgtttaaaggggttgataaactgctgttaatttcatccagtgaagtaggacaacgtgttgcgcagcatacggcggtgatcaatgcggccaagcgcgcgggtgtcaaacttttggcgtataccagcctgttacatgcggataaatcccctctgggattaggtgaagaacatcgggcaaccgagggattgctacgtgattcaggtctgcccgtcgtattactgcgtaatggctggtataccgaaaattatgcggcaagcatcgctccagccttggcccacggtgcatttatcggtgccgcaggcaatggacgtatcgcttcagccagtcgtgaagattatgctgaagctgccgccacaatactggttcaggaaaatcaagccggtaagatttacgaattggctggcgatgatgcctatacattatccgaattctcggcagaaattactcgccaatccggtaaagcagtcgcctaccaagatttatccgaggcagactttaaacacgccctaatcagtgccggtttacctgacggcttggccggtatgctggcggattcagatgccggtgccgcgcaaggtgggttatttgatgactcccatacattgagtaaacttattggccgcccaaccaccccttatgccaaggtaataacagcaacactggcgacacgttaaactgccttaatagcttgatcacctaagcgaatcaggccccatgctgtcttagatggcctgatttgcgatttatctgttacgccatttattggttaagctatttcgctgttaagccaagccgccgcggggttgtctccctaactttgatcaagcctatcgaagtcctcgtcatggtagacaggtgcagatatcgaacttattcctactcccacaaaaaattttcactttaatgcagattcacgatatatatccgaatcaaccttaacaaataattcctgtgttattcataactaataaacatttgtgcgagaattatcttataacgagcatgtcatgtaactttttaacttatttcaacaccttcagcagcgaactgaagagcgcctcctctttatgaaaaaaaacattaattaatttaatcaatttaagggtgatactttccgcagtaataatctcaaccacttgttttaatgtgatttaattatattttttaatgcgttaaatcgttttaaatctttgagttaacgtacaacacataataatcacataaaaaatataacgttctaaataagtgcaaaggcagaaataaacagcacctttatagggcataaataatttaataaatgtaagtataaagttttcctcaatgacgccgattatcgtcagtaattattatttatataccctaaataattcgagttgcaggaaggcggcaagcgagagacacatcgtctggaaccgatttgaacagcatttatgctagctcgcaggataaggctcattaatctcgataagcttacttatttaaggtcaacgaccagtaagtaattcggattattgaacgtagccaacgcacaggtaacttgaagtataacgggtctattgactaccagggatctcctccctttactgaggttaatatgagagttaacaaacctgtcagccggcaggagtatcccattgagcgcgatatcaccttgcagtccaccactgatattcatggaaatattgcttacgctaatgctgcttttgttcgtgccagtggctttgaatatcaagagttgcaaggtcaacctcacaatatggtcaggcaccccgatatgccacccgcggcttttgctgatatgtggcaaacattgaatgccggtctttcttggtcttcattggtgaagaatcgccgtaaaaatggagattattactgggtccgggctaatgcgacgccactgcgccataatggccgtttaaccggttatatttcggtacgtattgcgccaactcgcgatgaggtaaaacaagctgaagcattgtataccgatttcaacaccggtaaggcaaaacggcggcatattgccttgtatcgtgggctgatcgtgcgcacggggtggctctccccactttctttgttccaaactttaccattacgctggcgcctgcggagtgccttgctaagttccgccatcattccaaccgccgccgccagtgtgatggaggtagcgggtcaacctctcttgattctcggctcggtggcattgacctggagcgtattggcttcactgtggttggagcggcagattgcccgccccatcgcggctattttgcaacaggcgcaggacgtttcctccggagaagcaggcgattatgtacaactaaatcgtgtcgatgaaatcggttatttaatgcgtagcgtcaatcaactcggcctgaacctacgttctttaaccgatgatgtcagtggtcaggttgatgggattaataccgccagcaacgaaattgctgctggcaatcgcgaactaaaagtacgaaccgaacaagcaaccgataatctgcaacacattgtcagtgccacagaacaattagctgcgacagtgcagaacagcgctaacagtgccaatgaaacaacatcactcgccgaaatgagcagccatgccgcagaaaaaggcagcgagctcatgcaccaagtcattgaaactatgggcactatcaatgactccagccatcgcattgtagatattatcagtgtgattgaaggcattgcttttcagaccaatattctggcactcaacgcggccgtagaagcggcccgggcgggtgaacaaggtcgtggatttgccgtagttgccagcgaggtacgccatttggcacaacgttcgtcaaccgcagcaaaagagattaaacatttaattgagaccagtgtagagcgggtacgtgacggaagtactttggtgcaaaatgccggtgccaccatggataatattgtcaaacaggcaagccaggtctctacgttgatcagtgaaatcagcacctcgactcatgaacagacacaggcccttggccaaatccggcaatcgatcagtcggctagatcaaatgacttaccagaatgccgcgatggttgagcaatatgctggcgcggcagaagaactggcacatcggacattgcgactaaccgcggcggtccgtatttaccgcccattgaataacgtaggaaagttaagggattagacagaatcaccgcattatctgttacccctatcccgactggcaggtgatttatcatagcaataatctaaaacctcgctatagtgggtaggtggttatccaattattaaataaggagttttatgtcatcaattaaccaaacatctgttcgcgctcacacaggtgaaactggtgcaaacttacctggtgaagatcatttgatcgcccatgaagctttgcttgtcgccttaatggttgaatgcgcgaatgagtcagataacgatcagttcctgcttagcatccgagaaacgctgaacggcattttaagttcctcacgttatcttgatgccaatgctattgcgaatggccttattgatgaggccgatgacaaggccaaccgctagcattcagccttcaatacattcattcctcaatacattcagccctcaatattgagggcgttttactgccgcctgccaagcccaaattgttagtgcacaacacatatcatatacaaacccttaacaaaaccaatcgaacctcaatagcctcgtataattgatagataatagtgatatcactacaactataaaatgagagcaacagcatcacccatgacaatataattaccctgccagcctaatccaggaggtacgtaatggtctcactgaaagaagtggcaaatctagcctctgtttcattaatgaccgcatctcgagcgattaatagcccagagcaactgcggccggaaacgtatcagcgagtgatgcaggcgattgaatccctgaattatgtgcctgattttgcagcccgtaagatgcgcggccacgccaccaaaacatcaaccctggcagtactcgcctgggatacggcgaccacaccgttctcagttgaaatattgctctccattgagttaactgcccgagagtttggctggaacagctttttagtgaacctaacctcacgcgaggacagccaacgggcgcttaaccaactactcgcccaacggcccgatggcattatttttactgctatggggctacgtcaggtcaccattcccgagcgatttcgggataaaaacattgttctcgctaattgcgtcagtgaaagccattcaattcctagctacattcccgatgattttgatggtcaatatcaagccatgaagttgctgctgcaacgcggatatcagcggcctttgtgtatttatctgccggagtgtaccttggcaggcaaggcccggcgggcaggggtagaaaaagcctggcaggaatctgcattaccaacagagcaactcaatcagtgccatatagcgtggggagatgaacattatcaggatgtcattccgctattggaacgccattgccctaagggaaaacctaattttgatgtgttaatttgcggcgatgaccgtatcgcatttttggcctatcaggttttactggccaaaggtgtggtaattccacaacaggttgcggtgatcggctatggcgatatggttggtattggtgaattgtatctaccaccactgaccacagtacaactcccctattatgatattggtcgtcaagctgccctccatttaataagaggacgtgaatcgcgggcaatacatcggttaccctgcccactactagaacggggatccatccgtgactcaatgcctaataactgtgtgcctcttttcagtaaacagcgataaatagcgctcatggatgcatgctaaggactgatgagtggcaagaacggggctgcgttatacggggcagcacgccataaatagtataaacttcacgaaagcataagccctcgtgaagtttatagatacgtcagaattacatgtgcttaataatggcgtcgccaaactcactacacttcaacaacttagcgccttccatcagacgttcgaaatcataagtcacggtcttggcttgaattgcgccttcagtgcctttaatgattaagtcagcggcttcgaaccagcccatgtgacgcagcatcatttctgctgaaagaataatagaacctgggttcactttatcctgaccagcatattttggtgcagtaccgtgagtggcttcgaacagtgcgcagtcatcaccaatgttagcccccggagcaataccaataccgccaacctgagctgccaatgcatcagagatgtaatcaccgttcaggttcatacaagcgataacatcatattccgcaggacgcagcaggatctgttgcaggaaagcatcggcaatcacatctttaacgataatttctttgccgttatttgggtttttgattttaacccatgggccaccgtcgatcagttcaccaccaaattcctcacgcgctaactgataaccccagtctttaaacgcgccttcggtgaatttcataatgttgcctttatgaaccagcgtaactgattcacgatcgttggtaattgcatattcaatcgctgcacgtaccaaacgcttagtcccttcttctgaacacggtttcacaccgataccacattgttcagggaaacggattttcttcacacccatctcttcacgcaggaacttgatcactttctctgcttcgggtgaacccgctttccattcgatacccgcatagatatcttcagcgttttcacggaaaatcaccatgttggtcagttcagggtgttttaccgggcttggggtgccttcataataacgcaccggacgcagacacacatacaggtcaagttgttgacgcagagcaacgttcaaagaacggatgccgccaccgacaggagtggtcaacgggcctttgatagcaacgcgataatcacggatcagatctaaggtttcttctggcaaccaaacatctttaccatagacatgggttgatttctcaccagtgtaaatttccatccaggaaattttacgttcaccgttataagctttcttaaccgcagcatctaccacgttgatcatcgccggggttacatcaacaccaataccgtcaccttcaataaatggaatgatcggattatgcggaacaaccagtttaccctgagcatcgacagtaattttcttaccttctgccggaacaactactttgctttccatcaacctctccttcagcgcaattttgttaatgctttgtaagattcgtgtcaatactacttgaatattcgttccgcgccaatccgaaacggattggggtataatgcgctaatcattcgaaaccgcaataatcatgaataaattctctgttaaaaatcacaaagttaaccgattcagcactaaggcacaagccaggcagtccccccccgctgcgccacggcgggtattgttattcaataaaccttttgatgtattaccgcaattcactgatgagtctggacgcaccactttgcagggtttcatcccttttaaggacgtttatgctgctggccggttagatcgcgatagcgagggcttattggtattaaccaatgatggcaagttgcaagccaggctcacgcaaccggcgcaaaaaacaggtaaagtctattttgtacaagtggaaggggtccctgacaacgatgcgctcacacagctaaaacgaggcgtaacgttgaaagatggcctgacgttacccgcaggcgcggagttagtggcagagcctgagtggctatggccgcgccatccccctatcagagagcgtaaaaccatcccgaccagttggttgaaaataacactttatgaaggccgcaaccggcaagtacgtagaatgaccgcacacgttggcttccctaccctgcgcctgattcgttttagtatgggaaatttaagccttggcaacttacagcccggcgaatggaaggagataactgatgtttaaaccgcatgttactgtcgcctgtgtcgttcatactcaggggaaatttctgatcgttgaagaaaccatcaacaatgaaaaacgctggaaccagccagccggtcatctggaagccgatgaaaccctcattcaggcagcagaacgcgagttatgggaagaaacggggattcgcgcgacaccacaacattttttacggatgcaccaatggctggcaccggacaataccccctttttacgtttcgcttttgtcattgaattacccgcccaactgccaacacagccccatgacagcgatattgatcgttgcctgtggctaagtgccgatgaaatattgcaatcgatgcatttacgctcaccgttggttgcggagagtatccgttgttacctgcagccagagcgctattcgcttgatcttatagggacctttaactggccgctctgaccctcagccagatttattcaggtaatttaccccggagagtgaatcggcaatgcaccgttgcgggcaacgtgataaaatccggcgcttgtttttataatgcctgatccaagtcaacggcttactcggatggtaccctccgtcaaactgcagacagataatccaggtgtttacgtgagtgagactcctatgtcagataatagccagaaaaaagtcatcgtcggcatgtccggcggtgtcgactcttccgtttccgcttacctgctccagcaacagggctatcaagttgctggcctgttcatgaagaattgggaagaggatgatgacgaagaatattgctctgcagcgaccgatctggccgatgcgcaagcagtatgtgacaaactgggtatggagttgcacaccgttaattttgcagcagaatactgggataacgttttcgaattgttcctggcagaatataaagccgggcggacacctaatcccgatattctgtgtaataaagagataaaatttaaagcgtttcttgaatttgcagctgaagatttgggcgcagattatatcgccacaggtcactacgtccgtcgccaggatgttgatggtaaaagccgcctactgcgcggccttgatggaaataaagaccaaagctacttcctgtatacattaagtcacgaacagattgctcaaagtttgttccctgtcggtgagttagaaaaacctgaagtgcgtcgcatagcagaacagctcgatttagtcaccgcaaagaaaaaagactctacgggcatctgctttatcggggagcgcaaattccgtgatttccttggccgctacctgcctgcacagccaggtccgatcatgacggttgacggccaactggtgggcaaacaccaagggttgatgtatcacaccctcgggcaacgcaaaggtttaggtatcgggggtaccaaagaggggggtgatgacccgtggtacgtcgtggataaagacctggacagcaacacgttactggttgctcaggggcacgaacaccctcggttaatgtctgttggcctggttgctcaacagctacattgggtcgatcgccaacccgtgaccgcccctttccgctgtgtcgtaaaaacacgttatcgtcagcaagatattccctgtaccgtaacaccacttgatgacgaacgggttgacgttcggtttgatgacccggttgctgccgtcacgcctggccagtctgccgtcttttaccaaggtgaaatctgcctggggggcggtattattgaacagcgttacccactgactaatccggcataaaataatccagtgataaatggaagccagtaacaaatcagaacgtttacaggagtgatcgtggcgaagaattattatgacattacactagcgctggcagggatctgtcagtctgcccgcttggtccaacagttggcccatgaagggcagtgcgataatgacgcactgaatacggtacttagagggctgctacagaccaatccctcttcaacccttgctgtctatggcgatacggaacaagtccttaaaatggggctagagaccttgcaaagtgtattaaatgccaatcgtcagggcgaggcggcggagctaacccgctataccctaagtttgatggtgctagagcgtaagctcagcgcaagtaaatcagcgatgaatacgttaggtgagcgcatcagccaacttgatcgccaactggcgcattttgatctcgaatccgaaacgatgatgagttcgctggcatccatttatgttgatgttgtcagcccactgggcccacggattcaagtcactggctcaccggctattctacaaagccccttggtgcaggccaaagtccgggcgaccttactggcgggtatccgctcagcggtgctttggcaacaagtcggtggaagccgtttacagttaatgttttcgcgtaaccgtctgtttaaacaggcacagagcattcttgcccatacctaattcttgctcatacctcattgaaatatgaacgttaaaatctgacctcaggagttgccaccaatggaattatcctcactgaccgccgtttcaccaattgatggacgttacggcgacaaagtcagcgcactgcgccccatctttagcgaattcggtttgctaaaattccgtgtgcaggtcgaagtgcgttggctgcaaaaactggcagcctgcgcagaaattaaagaggttcctgcttttgatgccaacgcaaacgcttaccttgataaaattgtgcaagagttcaatgaacaagatgcacaacgcattaagaccatcgaacgcacaaccaatcatgatgtgaaggctgtcgagtattttctgaaagaaaaagtggaaaatctccctgcgttacatgccgtgtctgagttcattcactttgcttgtacttcagaagatatcaataacctgtcccacgcattgatgctgcaaactgctcgccaggatgtcctgctgcccgcatggcggcagattattgactcaataaaagcactggcccaccaatatcgcgatttacccttactgtcccgcacccacggccagcccgcgacaccctcaaccatcggtaaagagctggcgaatgtggcgtaccgcatggaacgtcagttccgccaactaacacaagtggaaattctgggtaaaatcaacggtgcagtaggcaactataacgcccacatcgtggcctaccctgaggttgattggcatcagtttagtgaaagttttgtgacatcgctgggaatcaactggaacccatacaccacgcaaatcgagcctcatgattatattgctgagttatttgactgtgtggcccgtttcaatactattttgatcgattttgaccgtgatatctggggttatattgctctgaatcacttcaagcaaaaaaccatcgcgggcgaaatcggttcaagcaccatgccgcataaagttaatccaattgatttcgaaaactcggaaggcaatttgggtctatcgaatgccgtgctaggtcacatggccagcaaactaccggtttctcgctggcaacgtgatctgaccgactcgaccgtgctacgtaatctgggtgtgggtctgggttatgccctgattgcctatcaggcaaccatgaaaggcatcagcaaactggaagttaacgaagcacatctgttgcaagagcttgatcataattgggaagttctggctgaacctattcaaacgatcatgcgccgttacggtattgaaaaaccgtatgaaaaactgaaagaattgacccgtggcaaacgtgtcgatgccgcaggtatgcaagcatttatcgatgggctggatctaccagaagaagaaaaaacccggttgaaggccatgacgccagcgaattacattggccgcgccaccaccatggttgatgaattaaagtaatattttttatctaatacaggtggcttagtttggtaaaagctaacgccatctgtattattccttccccccctttcccaacgcctcccccactaaccttcgctgttcatccactgtttacccgctgtttaacggctgtcattgataatgctcacaatttcaaaaggacgttacaatcacaggagctgttatgttgaaacaatccctattatcccttgccctgatgggttcctgtagtgtcgccatggcagataactacacttatgtcgctggtggtttgcagttcggttcaatcaatagcaactcacgctttgatcaacagtttgaccgacaaaattatagccatattggcaataaaaatatgggtgggatttatcttaacggcggttatagctttgataactcgctcttcattgatggccgacttagcagccttgccaatgataaccgtggtagtgcagatgccgttcttggattaggctattattttgcttttactccggatattgatttctacaccgtcgtgggtgccagccgccatgcattagtatttgatgccagcaaagacggtaaaaaaaccaatacttataacagtgctagcggtgaaattggggttaaaaccaaactatcaccagatattggcgtgaacatcgcctatcgtctggcaaattatgataaacgcgcatttcatgaagcgcggatcatggcagattatgctctgacacaaaaactggccgctgaagtcggttatacctaccataactggcgagtcagtgaccaagcgatgcaagtcggcctacggtataacttctaatatcgttacagcgcttaaatggctaccacatttaaattgttacaacatttaaattgttgcaacgtttacattgtgacggcgtctaagtttttatagcgcgccatgcattatcgtgctcaagacggtatagcacctacataatgagcgtcaaattttcacttaccggataatatcctgttatccggttaacgttttatcaaggattggtgtatgcgggttctggttgtggaagataacgcgttgttgcgtcaccatctgacagtgcaaatgcgtgaaatgggccatcaggttgatgccgcggaagatgctaaagaagcagactatttcttacaagagcatgcccccgacattgctattatcgatcttggtttgcccggtgaagacgggttaagccttatccgtcgctggcgtagccatcaagaaaacttacccattttggtcctgaccgcacgggaaagctggcaagataaagtcgctgtactggaagccggtgccgacgattatgtgaccaaaccgttccatctggaagaggtcattgcccggatgcaagcactgatgcggcggaatattggcctggcctcccaaattattgagctaccgcccttccagattgacctttcacgccgtgagttatgtgttaaccaacaacaaattaaactgacggcatttgaatacactatcattgaaacccttatccgcaacgcagggaaagtcgttagtaaggatacgttgatgctacaactttatccggatgcggaattgcgagagagccatactatcgatgtattaatgggtcgactacgtaaaaaactgctggcagaacatcagggtgaagtcattacgactattcgtggtcagggatatcgttttgacgtcaactagacactatgctcagaaaaaataataaacccttctcccttcgagcccgttttcttatggcgacagccggcgttattttagcgctgtcgctatcttatggcatggtcgcggtggtaggttatatcgtcagttttgataaaagcaccttcagagcccatcgtggtgaaagtaatttattcttcagtctggcacagtggcataacaacaagctcagcatctctgttccgccagaacttgaactgaacgtccccagcctggtcctgatttacgacaaagatggtaatattctatggcgtcagcgtcatgtccctgagctggagtcgcacattgagaaaagctggctgcaaaagccggggttttatgagctggataccgggacgcacatcagtagaatgatgatgggtgacaacccaaaagctcaagatcagttaaagaaatacgatgacaccgatgatagcgcacttacgcactcagtctccgtcaatacctacgccgcgacctctcgtttacctcaactcaccatcgtggtggtggataccatcccacaagagctacaacgtactgatctagtgtggaactggttcagttatgtcctgctggcgaatttattattagtcattcccttattgtggcttgctgcctattggagcctgcggccaattaaagcactggctagtcaaatcagccagttggaaaaaggtgagcgtgaacaactcgatgaaaacccacctcgtgagttacaaagtttagtccgtaacctcaacatcttgctgatgaacgaacgtcagcgctataccaaatatcgcacgactctggctgacctcactcacagccttaaaacaccgctggcggtgctacaaaccacactacgttctttgcgtaccggtaaacaaacaaccattgaagaagtagagccgattatgctggagcagatcagccgtatctcgcagcaaattggttattacctgcaccgcgcaagtatgcgttccgaacataatgttctaggacgtgaaattcattcggttcccgcgctactcgatagtttgtacagcgcattaaataaagtttatcaacgcaaagggattgcgctgacactggacatctcaccagaggtcacattcttgggagaaaagaatgatttcatggaagttatggggaatgttttagaaaatgcctgcaaatattgccttgagtttgttgaagtcaccaccttacactccgaaaaacaattgaccattgtggtcgatgatgacggccccggtattcctgaaaataagcgccagttaattttccaacgtggtcaacgggttgatactttacgtccggggcaagggcttggtttatctattgcagctgaaattattgaacagtatcaaggtaaaatctccatcaccgaaagccccttagggggagcccgaatgatggtgacgtttggtcagcaacaagattgtcacgatgattaataatatttgccagtcagcccctgatactgatggcgggtatccgttataatctcaggcaatttcacctttatcctggaataaacatggattaccaactcgatctcgattggcctgactttctacaacgctattggcaaaagcgccctgttatcctcaaacgtggcttcaaaaattttattgacccactctcaccagatgaactggccgggttagccatggaaaatgaagtcgatagccgcctggtaagccatgaagatgggcgttggcatgttagccacgggccatttgaaagcttcgatcatttaggtgagaacaactggtcattgttagttcaggcggtagaccattggcatgaacccgcggcggcgctaatgcgccctttccgtccactctctgactggcgtatggatgatttaatgatctccttctccgtgcctggcggtggtgttgggcctcattttgatcaatatgatgtttttattattcagggttcaggccgtcgccgctggcgggtgggcgaaaaaactgaaatgaaacaacattgcccgcacccagatttgctccaagtggggcctttcgacgctatcattgatgaagaaatggagcctggtgacattctttatattccaccgggcttccctcatgaaggctattcccttgaaaatgcgctgaattactccgttggtttccgcgccccaagtggtcgagaactggtcagtggttttgcggattatgtattggctcgagaactgggtagctatcgttatagcgatccagatttacagctacgcgagcatccagccgaagtattaccgtccgaagttgataaactgcgcacaatgatgctggatctggtccagcaacctgaacatttccaaaactggtttggtgaatttatttcccaatcacgccatgagttggatattgcaccgccggagccgccttatcagaccggcgatatctatgaactattgaagcaaggcgatgaattacaacgccttagtggattacgggttctgcgggttggtgatcgttgctttgctaatggtgagttgattgatacgccacacttacaggctgccaatgcactgtgccagcactttagcgtgaatgcagagatgttgggtgatgcacttgaagacccttctttcctggcaatgcttgcagcactggtcaatagcggttattggtattttaacgattgatcaacgggttatggcagtacgtgtttataacagtatgtgtttataacagtacgtatttattgctgctgacaaaccccgataactcgatctgaaacggtgaggataggcagaagaataaagcgcctgggacgggtttacagcatctttacttgctgcctattcactccgctatgggcactttgtcaataacctcaaacgccccttttcggggcgtttctctctatcgttcagcttatgattctttagcccgcttggcggtcagctcagaaattcgcataatgactgcaaccgctttttccatcccttccagcgtaataaactcatgtttaccgtggtaattatagcctccggtaaaaatattcgggcaaggtaaccctttaaaagagagttgtgcaccatcggtaccaccacgaattggcttcataatcggagtaatatcacaatcaagcatggcctgttgggctaattcgataatgtgcgggtgcttaataatctgctcacgcatattgtaatagctgtcatcgataacaatttcgatataacaatcacgatgtaaacctttaccaacccgcttggcgatatccaccatattcttcttccgcgcttcaaagctatcgcgattgaaatctcgaacaatgtagtgcatctcagcgcgttcaaccgtgcctttaatactttgcagatgatagaaaccgtcgtaaccctcagtacactcaggggtttcatctactggcaactcttgatggtaacgggttgccagcgacaacgcattaaccatgacgcccttagcactgcctggatgaacattattgccgacgatctttattgccaccgatgctgcattgaaattttcaaactctaattcaccaatgccgccaccatcaacggtataagcccactgtgcatcaaactctgccacattaaaaaactgagcccccttacccacttcttcatccggtgtgaaggcaatacgaatatccccatgggggacattacggtgctttaagcgcaccatagcggtaatgatttcagcaatacccgctttatcatccgcccctaacagggttttaccatcagtcgtgatcaaggtatgtccaagtaattgatgtaataccgggaacataacaggagataaaacctcatcaccaatacctaacgcaatatcaccaccacggtagttctccactatctgtggattaacatttttacctgaaaaatctggtgaggtgtccagatgggcaataaagccaatcgtggggaccggccaggagacatttgccggcaatgttgccatcacgcaaccatgatcgctcaaggtgacgtgggaaaagcccaacgtcaataattcctgttgcaacgcctgagcaagcttgcgctgtccctgagtgctcggcacagattttacattggcttttgcttgtgtatcaaaagaaacatagttgaaaaatcggtcgagtaatttgtccatggttcccaccctcataatagtgaataacattatggggaagtgatcatgatcaaatattgcgtcaggtcagctttagataaacttaagccagaataataagaggtagtgacgaggtactcaggaatatgagctcatcacccctgagtgatttatagcttatttatcgccttttaatctgaagttacaggtttgctagcggctgtcacgccccgaattactggcacgaatcagttcgccgggacgtgttgattgactgacgacctgcaacactaatcaatttgggtatatccgtaagttatctgaatgagttgaggcacccaacggggaaatcaatccccctgacgattctcaccgcatgtggtcagaaactcgcgaatatattctggtaccactttactggcgaggccatagtgcttctcatcaaactggctttctacctgactaggttcaagattcagttctactgtatgggcaccatgtagatgagattcatgaacaaaccccgcagcaggataaacatggcctgaagtgccaattgaaataaagaaatcagcctcagccagcgcctgataaatgtcatccatacccatcggcatttcgccaaaccaaacaatatgcggccgtaatggcgagggaaattggcaacaatgacaacgttcatccgcactgagatcgccttgccaatccagtacctgaccagattgagtacagcgaacttttagcaattcaccatgcatatgaataacgcgcttactgccggctctctcatgcaagttatcaatattttgagtgatcaataccaggttatcacccagcacggcttctaaatcagccagagcgaaatgcgcagcatttggcgctatgtctggctgctgcaactgacggcgacgttcattataaaaacgttggacgagctcaggatcacgccgatacccttcaggtgtcgccacatcttctacccggtgatcttcccataaaccatcgtccgcacggaaagtacggatacccgactcagcagaaatcccagcaccagtaagcacaacgacaaagggtttcttcatctcttttgctactgcactatcccgatgaaaaatacgggagcgaaaacgttgatgccgcacatgcttactcttacgaaaccgacacagcctatggcgaatgcgcataaccttttgcctctttttctttatctgtcttgttattaatcgtgacgattatttttctgccaaatgcagaaacgctgcaccacgaacgcccccggaatcaccataacgcgctttttcgatacgcggtaaccgggccactcgcaataaatgcgcaggcaagcgctttggcagctcctgatagattttttcgaaattagacaaccccccacccaccacgaccaaatggggatcgagcatagtcaaaagattgcccaaacagaccgccagcacatccataaagcgctcaacatgtgccaccgcctttggctcacccgcagcataatgggcaataatgtcggtggcaggtaaagtatgttgataaaaatgactgtacatccactcgaaaccgcgcccagaaatataattctctatacaaccgcgatggccacaaccacaggggacgcggggaatatcggcaccaagaatatccagtgcatctactggtaaacggaaatgaccgaactcgccagtgatgtggttacgcccactgacaatactgccattaacaattaacccaccaccaacaccggtgccgagaataagccccagcaccgttgggtaagtgcgaaactcagggtcccaggcttcggagagagcaaaacagttggcatcgttatcaatacggacttcacgctggatcaagcgggaaagatcagcctgcaatggttgccccatcgcagacggtacattcgcagtaaataccgtgccatcatccgcattgggtagccctggaataccgatacccacactgccttgaacaccgcaataagtatcggcttcctcggttaaatcccgcaatatttgcagtaactgcgggtaatcctcacgtggcgtaggcactcgcttatgccatattcgctgcaggttttcatcaaaaacgcctagctctattttggtcccgcccatatcaaaaccgtaatacataagcttgcctttcttcaattactgcccgctgaggacccgtgccggatcaatacggctggcgcgacgtgccggataccaactggcaatcaagctgagcaccagtgccgttgccaacacacaagccacatcaaaccaatgcaactctgacggtagaaaatcaatgaaatagatatcgctcgacaaaaattgatgcccgaccatcttttctagcccgcggattatggtggtcaactgtagggagacgataacccctatcacggccccgctgatactgccaataaggccagccaacaggccataccaaatgaagatggcgcgaatcagaccatctttggcacctaatgtacgtaatactgcgatatcgctacttttatctttaaccgccatgaccaacgttgacacaatattaaaactggcgacgccgatcacgagtaccatcgctaaatacatgatagtgcggatcatttggatatcacggtacatatagccataggtcccaatccagctactgatataaacgtatgcgttactcacttcacccgcgttacgtaccagttgattggcgttgtaaacatcattcactttgatggcgatacccgtgacactatcacccatatcaagatattgttgtgcatcgattagaggcactaatgccaaactgtgatccaactgaccactcagttgaaaaataccggcaacctgtaaacggatgcgcttaggttgcagcaatttcatctcaggatcgctgttagggatcatcaccgtcaaccaattgccttgcttcacccccaaggtatcagccaaccctttacctaaaataatctgttgttgcccggccttaaaatggctccaggcattgtcaagaacgaagctgggcaacgcactgagatgctgttcggcctcgggatccacacctttgacctgcactgcccgcagttgcgtactgttttcaatcaaaccagtaaaattaatataaggcgcagcagccacgataccgggcaccttttcgatacgctgtaaggtttgtggccaaccgctgaacggctgattaaccacggcaatttcgccgtgaggcaccaccgctaaaatacgatttttcaactcacgttcgaagccgttcatcgcacttaaccccacaataagcactgccacacccaaggcgatacctaacgtagaaatcacggagattaacgacaccataccgccacgacggcgaccacggctaaaccgtaaaccgataagaagtgaaagtggcgaaacccccatcactcggcccccaccagcgtcaaatggtgttgtagctgaccatctcgcatttcaagttgacggctcatccgtttcgctaattgtaaatcgtgagtcaccaccagaaacgcggtcccctgacgaacattcaattcacctaacagattaaaaatactgtcggcattgcgttggtccagattaccggtaggttcatctgccaataccagcgatgggttatttaccaaagaacgggcgatagcgacccgttggcgctctccccctgataactccgatggacgatgtttactgcgcttcgccaaccccaccgccgccagcatctcatgggctttctcttgcgcttcagcgggtttactgccgccgatgagtaatggcatggcgacattttctaacgcggtaaaatcgggcaacaaatgatgaaattgatagataaaacctaactcccgattacgcaattcagctttcgcggtagaagagagttggttaagcgaacgcccctgataaataacctcaccagaggtgggtgaatccagcccccccagcaaatgcaacagcgtgcttttacctgaacctgaactgccgacaatcgccatcagttcaccaggctcgatagcgaaagagacattgcgcaggacatcagtatgcagttggccttcctgataacgcttgcacaggtttatacattgtaataaaggatgattactcatagcgtaaagcctctgcgggttgtgcggcggcggcgcgccaggaagggtacagcgtggacaacagagcgatcaccatggctagcagtgcaatgaccgtaacctgaagtgggtcaatctccacgggtagcgttgcgccatcaatcaatacgcccaaaatagggatcagggtgttcaattggctggcgagtaaaacccccagccctacccctagcaatgcgccgataaccccagcggtggcaccttgcaccataaacaccaacataatttgccggcgactcaacccttgggtttgcaaaatcgccacctcgccttgtttttccatcactaacagccccagtgacgtaatgatattaaaggctgcgacagcaataatcagactgagcaataaccccatcatgttcttttccatccgcacggcctggaaaagctcacctttacggtcacgccagtctttccatacggtgccttctggcaaactctgctggctcaggctatcgaccgacagcggctgcgagaggaataagcgccagccggtaatattcccaagagggtaacgcatcaggcgtgatgcatcctgctggttaaccaaaatttgatagccatcaacttcgctattcgctgcaaaggtgccgataatattaaacacacgctggctgggaatacggcccattggcgtgaattggctggcgctcggtaccatcaaacgcagtgtttcaccgcgtttaaccccgagctggcccgctaacttctcgccgaggatgatgttgtagctacctggcgctaacgcttttatatccacgttaaccaaataattggccaatggttcatgctgctgtggatcaacccccagcatcacaccggcggccaaattacgcgcactttgtaacaccacatccgccgtggtcaacggcacaatatcactgacaccgctcagcgattttagggttgaagccggtatcttgtttggatccaaagaaccttgtggtgtggtaatcagcgcctgtggcataagccccaaaatcgtatcttgcagattacgctcaaaaccattcatcacagacaataccgtgataagagccatcacccccagcgtaatgccaatggtagaaagccacgaaacaaaccgaccgaagcggtcagaagcacgcccacgcatataacgcaggccgataaatagggcgacaggttgatacatgaaatctgtttagatcctgttgctaaaacaaagtgatcgaggataataaagggtactcccgctttatggaaccattaaccgtctatatctccggcttttattccaaaaaagggcgcttatctgtagcgatggcctttcgcgtgctaggatagccgcccagataatttgtcgtcgctgttgtgctgctactatcatgccaaaattaagcgctggttagcgactggtcaatcatcagttcaaccacatacaaagagactgtttaactgcttatgtcccaacaatatcgttattcattgcctgaacgacgtggtgatacccgtcagttaggccagttgaccggatcagcctgtgcggtcgaatgtgccgaaatcattgaacgccatgatggcccggtaatgctgattacccccgatatgcaaacggccttgcgcttgcgtgatgagatccagcaattctcgccacaacccgtaagtaccctctccgattgggaaacgctgccttacgatagcttctcgccacatcaggatattatttcggcccgcctctcttgtttgtatcatcttccggcaatgaaacgcggtgtcattattctcccaattaataccctgatgcaacgagtgtgcccacacgaatttctacatggccacgctttggtgatgaaaaaaggccagcacttgtcacgggataagttacgcgcccaacttgagcaagcgggctatcgcagtgttgaacaggtcatggagcacggtgagtttgcgacgcgaggtgcgttgctggacttatacccaatggggagcaatgaaccgtatcggattgatttttttgatgatgatattgatagcctgcgggtatttgacgttgattcgcaacgcacactcgtcgaagttgagcaaataaacttactgccagcacatgagttcccaatagataaagcggcgattgaattattccgtagccaatggcgtgaacagtttgaagtccgtcgcgacaacgaacatatttatcagcaagtgagtaaaggcatctggcctgcgggtatcgagtattggcagccgctgtttttcagccagcaattaccgacattgtttagctatctgcctgaaaataccttattggtaaacaccggagatctggaaagctcggctgaacgcttctggcaggacgttaaccaacgcttcgaaagccgccgtgttgacccaatgcgcccactgttggcccccgagagcttgtggcttcgggttgatgcgctgtttaatgaattaaaagagtggccgcgtgttcagcttaaaacagaggcgcagcccgccaaagccgcgaataccaatttatgttatcaaccgctgcccgatttatccgttcaggcacaacaaaaagcgcctcttgataatctgcgtcgctttattgaatcgtttcatggcagtgtggtgttctcggttgaaagtgaaggccgccgtgaaaccttacaagacctgctggcacggataaaactcagcccaacactgataactacgctgtctcaggtggctaaccccggccattatctgatggttggggcctcggaacgtggcttcctcgatactgacaaacaactggcgctgatttgtgaaagcgacctactcggtgagcgtgtcagccgtcgccggcaagataaccggcggaccatcaacaccgatacgttgatccgtaatttggcagaactccgccccggccagccggtagtccatctggaacacggtgtcggccgctatctggggctaaccacccttgaagcgggtgggataaaggctgaatacctgatattgacttacgccggtgaagataaactgtatgtccccgtgtcatcattgcatctcattagccgctattcagggggtgcggacgataacgccccgttgcataggttaggcagcgatgtctggagccgggcacggcaaaaagccgccgagaaagtgcgggatgttgctgctgaactgctggatatctatgcgcagagggcagttaaatctggctttaaatttaaacacgaccgtgagcaataccagctgttctgccaaagcttcccgtttgaaaccacgccagatcaagagcaggcgatcaacgcggtgctcagtgatatgtgccaaccgttagccatggaccgcttggtttgtggtgatgtgggctttggtaaaacggaagtggcgatgcgggccgcatttctggccgttaccaataataaacaagtggcggtgttggtacccaccaccctgctggctcaacagcattttgataatttccgtgaccgctttgccacttggccggtacggattgagatgctatcccgttttcgcagtgccaaagagcagcaagtcattctggaacaagccgctgaaggcaaaatcgatatccttatcggtacccataaattgctgcaaagcgatctgcattggcacgatctcggcctgctgattgtggatgaagaacaccgcttcggcgtgcgtcataaagagcggatcaaagcgatgcgggctgatgttgatatcctgaccctgacggccacgccaatcccacggacactgaatatggcgatgagtggcatgcgtgacttatcgattatcgccacccctccggcacggcgtctggcggtaaaaacctttgtccgcgaatacgatagcctggtgatccgtgaagccatattgcgtgaaatcctgcgcggtgggcaagtctattacctgtacaacgatgtggagaatatcgaaaaagtcacgcaaaaactggctgaattagtccctgaggctcggatagccatcggccatggtcaaatgcgtgaacgggatctggaacgggtgatgaatgatttccaccatcaacgcttcaatgtgctggtctgtaccaccattattgaaaccggtattgatattcccagcgccaataccattattattgagcgagcggatcacttgggtctggcgcagttgcaccagctcagaggccgggtcgggcgctctcaccatcaggcttatgcctacttgctgacccccaatccaaaagccatgagcaccgatgcgaagaaacggctggaagccattgcgtcactggaagatctcggtgcgggctttgcattagcgacacatgatttggaaatccgcggtgccggggagctattgggcgaagaccaaagcggccagatgaccacgattggcttctcgttgtatatggagttactggaaagtgccgtagatgcgctaaaagagggccgcgagccttcattagaagacctgaccagcaaccaaaccgaaatagaaatgcgcatgccggtgctgctgccagaggatttcatttcagatgtgaatatcaggctttcgttctataaacgtatcgccagtgcacgcaacgaaaccgagctggatgagttaaaagttgagctaatcgatcgctttggcaaattgcccgaccccgcccgctatttattgcataccgccgaattgcgtcaacaagcccagaaactgggtatcaaacgtattgaaggcaatgagcgtggcggtttcattgagtttggcgagaataataaagtggatccggtgtatttgattgggctgttacaacggcaaccacagatttaccgtttggaagggccaaccaaattgaagtttatgcaagatttgagtgatcgggcgcaacggttgaaatttattacggagttactggcggcatttgcacaacatcgcattgcctagcctcggtatgtacacattatttataggtatatacctcaacgtgatatgcatgaagttgatcaaacgaaactaacgcgtgaagggtttctccacagtgagaaacccgcgttaatgctaatgccactcgcttaactgtgcagcccatttagctggctgaacgctctttctggctaaacgatcagaactaacactatctccgcgggttcttggtacaaggtcttggataacagatttggtattacgctcggttgttcagcaccagttgaccatttttatcaatggggatctgcatacctggatcacgatccatacgaatttttccctgctgatcgccaattttgtaggttacgtcatatcccagcgtcttctgtgatttgtcatacacggtctggcaacgctgttgggttgtggtataggtatcattttcctgcatattattttgcacacgattacctgcatatcctcccgctaacgcacccgctacggtagcgatatccttaccacggccaccaccgacctgatgccccaacaccccacctgcgactgcacccaacactgagcctgcgatcttattttcgtcttgtactggtttgcggtgcgtcactgtcacgttacggcactcttgacgaggcgttttgatggtctcttttatcggggttgcagtaagcactttggcatattgtggtgcactggagaagacatctatattcgccactgcagcaattcccagagcggcggcaataccaatccccacaccggctaacattgatttgttcacaggaaatcctcctgaaaatgttaccacgcactttttgtatcagaattttgcatagacgcattttcgtcataaaaacaaaaatctgaccacgcccgatacagagagttgccctctaaaataccgggatacggcgtgcgtgactcgccgtttgtaaacacaggggggagtctgcacaatgcatgttgaactggcaataagacaaaggagtcaaataccccaagagcaggtgtaagtgagtgtgtttaggaggaatctgaccgcgagtgtttattgatgtcgtatttttagtgacagggccgaataaatgcttctatttcattacttcaactatggtcgtcttgggactatttataaccccgatatgtactgttttatctgaacgttcagatttccaatattcaccactatcctcagtacgatctaatgtaaaacctattgaatataagtaattatgaattttttcaatatcattagaaccatgaaatgtaactgcactaacctctataccaggcccatccaccgttgcataaccaaattcataattcgatgatatacgaggacaattctttattatctcatctgtgagtaattgatagtgttttttatcctgttcggtataacgtgaattccctcccgttaatacttttatcgtcggccaaaaatatatcattggcaatgccacaattaatattaacacgataaaaattatagctacttttttcattgtacgactatcctaagaaatgggtatcaacttcaacaccatcttgtgaggcaatccccacatttcccgatttgaaattattgtaaggtattactgtttgcataaatgatggaagatatcccaaacggggtttgctattacgaaatttttctggatctgggaataacaatgacagaaaattttcatttttatacgaacctatgggaccgtagtaatcccaacgttttaacgcttcttctttgctcactgggcgcaatatctcgaacggacttgggatggaaaaaactcgataaaaacccaacaggtcagatactaaatcttctccgctaaaaccactatcagtcactaaattgaaagggaatgatgcttgcatagactcaaattgccgtgccaccctcatcatcatcgcgagagctatactgtatctctcgtgaagatgccttcctctctttattcgccatttgatcattcgggaaatagaaactttccttttcatccctagcattccttgtgaatattttacatcataataatctcccaagtttcgcttgctattcgaagactctccagcactcatttgtcggagaatgttcctgatatcgtctccctgtgcatggcctaaatctatccaccccagaacctcagtatatactaatccatgcgttgaaattcgcgctaaatggccatcaataatttcattacgtccactcactgtattttcccttttttaaaaaatataatttattccattacaacgttctttgcagatatttatcatctcttttcttaatattattaagaagaggaaacaactcagaattgaatttttcagatatttcttcgatgagcttatacgcgtcattgattgaaagcgagtgcacataagaaaatgcgccgtagcgccaggccccccaacgtcattggcactgtaagtcagcgacaaatcggttagaaaccaatttgaacagcatttatgctagcccgcagggtgagcctcacgaatgaggctcattaatcccgatgagtctattgattttaaggtcaacgaccagtaagcaattcgggtgagtgaacgccgctaacgccgctgcaacgtcaaatgtaaggggataattccccaaagtcattggcgttgcagcaaggcagcaagtaagcaagtaagcaagtaagtaagtaagtaagtaagtaagtaagcgaatcccgatgagtctattgattttaaggtcaacgaccagtaagcaattcgggtgagtgaacgccgctaacgctgctgcaacgtcaaggccgaaggggaatttagtgaagcttcaaccgtggcctaatcacccgattaatcccgcccaccagcatcatcagacctgtcttggtataaccatgtaatgcgacctgatgcatacgatacaacgagatataaacgacgcgtgctacacgcccttcgaccatcattgaaccacgcatcaggttccccatcaggctaccgacggtgctgaacttagatagcgaaaccagtgaaccatgatctttgtagatatatggtttcaggctctgcccattgagtaaggccagaatattgctgtagcagcggctggccatctgatgtgcagactgcgcgcgaggaggaacaaaaccaccgctcggttgcgggcaagaagcacaatcgccaatagcgaagatatttggatctcgggtcgtttgcagcgttggctcaaccaccaactgattaatacggttagtttccagcccggcaatgtctttcataaagtctggcgctttgatacccgccgcccataccatcaaatcagcatgaataaattcaccctctttggtattcaggccattttcatcagcactggtcaccatggttttggtcaatacgcgcacacccaatttagtcagttcttgatgggctgctgaagagatacgtggtggcaacgccggtaaaatacgttcacccgcctcaaccaaagttacattcagcgcgtggttatctaacccctcaaaaccataactgtgcaactgcttcaccgcattgtgtaactctgcagacagctcaacaccggtagccccgccgccaacgatagcgatgtctactttgcctttttcacccggttgagccgaatacttcaggaataggttgagcatttcattatggaaacgatgcgcctgatgagggttatccaagaagatgcagttatccttcacgcccggtgtcccgaaatcgttagaaacactgcccaaggccatcaccagaatgtcataggacaactcacgttgagtcaccagtacatcaccgtgttcatcacaaatctcagccaggctgattgttttgttttcacggttaataccggttaatgaacccagttggaaattgaaatagtgattacgagcatgcgccaaatagctcaacgcatcgacaccatcatccaaagagcctgtagcaacttcatgtaacagtggtttccacagatggctatggttacggtcaaccaggactatatctgcttttttactgcgcccgagtttatggccgagactggttgccaactcaagaccccctgcaccaccaccaataataacgatttttttcttcagcgttgtcaaaatgccccctaaatgtgaaccaattgttagctaagggtaaaaaataatatccttagataacatagggttcgctaatattaaatcaataaactgtggtcagaatatcatgcatggtcatatggtcataccaaaattgatatatatcaactttttttgattaaagtgacaccatgggaattttttctagaataggattcaaatagttagcgtttagtcacagtttggaatttttgtatttgcttaggatataaaggctatttttgctttttcgatgatgaaaatggcttggaatagaccgtaaaaaacccgtcccaagccgaataaccggccattcgcgttttttcaattaacctgccattaacaaatcaggccgttaacccagcgttttaaatgctttgatccgttgtagatgcggtgagagatctttaaatttatggttctgcttatcatcccatacgatctcatagtaaggatgtaaatcacccgcagtacgctgactgtcgagcatttcatcatggcgagagagcaccaccaagcagcgatcccgatttttttcacgaaagccatcaatacatttactggcaatatcaatgtactcttccggacgatcaattttgccgctcatattttcttgcggatagagattggggttgaacgctacctggcgaataccacataagaaaccaatacgttcagcccaaaaaccgcctaatccaacaccacaaatcaaggatttttcatcgcccccctgctgaatggctttatccacttctttcaacaaatattgcatatcatgccgtggatgtaaggtgctgtaactgataaagcgcacatcaggatcgataaattgtagctgtaaaactttctcgtgattgccggggctattggaatcaaaaccatgtaaatagacgatcatatttatcctcgctacggcatttttctgcgcggcagtgtgcgttactgatcaaagcccccacagaaaagagggagctcttggcccttatgaggcgagtaataataccgaagcgtacccggcgctactcctattgccccaacgtttgtttatgtgcatcccaacgttcgctgagtgccgttaatgctttattcgcctgttgccaacgggatgaagccatcaatgtctggcggtcaaattgccctgaatggtacaaacgggtcagttggtcggctttgatcggagacagattatccagcacactcacggccccctgacggttattacacaccaaaatcatatcgcaaccggcatccaacgatgcctggccgcgctcggcgtaactgcccatgatcgcagccccttccatcgagagatcatcagagaaaatgatgccctcgaaccctagctcttggcgcaatatctcttgtaaccaataggcagaaccgctggcaggccgtgcatcggcttcggtataaatcacgtgagcaggcataatcgcatccagtaatttccgctggatcaattcacgaaatataaccatatcatgagtaaggatttctgccagtggccgattatcatgtggcgtctctttatgtgaatctgcggttactgcgccgtgccctggaaaatgcttgcccgtggttttcatccctgcactgtgcatcccacggatgaaacactccgccattatccgcgcctgttgtggatcactgtggaatgaacgctcaccaattgcggcgctgacatggccaatatccagtactggagcaaaactgatatcgatatccatcgccatcatttctgctgccatcaaccaccccgcctcttgcgccagttgagccgcagtagcggcatcattgatagccgcaaaagactgagccgctggcaggcgggtaaaaccgtcacgaaagcgttggacccgccccccttcctgatccactgcgaccaccaaacgttcatgcgatgctgcacggatttggcgtactaattcgcgtaactgctccgcatcatgaaaattacggctgaataagatcaaccctcccaccagtgggtgttttaaaatctcacgctcttcagcatccagctcatagctggcaacatctaacatcacgggacccacggtcacctcactttattcagattgataacgacccttcgtgcttgaagcggcgggcttggtgccgcagggcttaaaaagacaaattaaaacgttggcgcaacggcgcggcccatgccaagaatattgggtccgcggtttgctgccaacgcacttcaaaccacatcaacatcaggtaatcgacccagggcaaccattgctgaatctgacgggataaacgagcgatgtcatgataaccgtgctcattgttgcaatagtcctgcaaaaaagcctgttgttgtagcattgaccaatgattaccgcgaaatagcgcggcaatttccaaagcaatatcgccatctgccgcatattcccagtcaattaatttcagcccaacgggggttgttaacaaattgccggggtgaatatccatatgtaaaggagcaatttttgttatcgctggtaatggcctacgaagaaaatcatgctgtagccgcactccgccaggtgaacggcgcgtaggatcaataagcgccccatagcgggcaatctgagcacgcaaatccagacggtaaccactcgcgggcaaatgatgcaagcgggccagtaaccgcgctaattgcccatgattcaccaatgggatgaactgctcattagtgacaacgtcaccttcaagccagttcaccactagccaacgctgattagcagcaatcaccgctggagacagcccattgccagcaatatgttgcaggaatttacgctcacgtcgtcggttgacccccaactgacttttgtgcggcgattgctcacgcgccagccagtcaatccctgggccagtaatacgccaactttcaccggttaatcctgataccgggctaatatgacaatcggcggttttcaccgccggattgatgtttgctattaaggcagacagagaagaatcaatattggacaggcgcattaccagaccaaatgatttcaccggtttgtgtctgcatcaattgcatttcaatggtcggagatttcacatcgccactgacatcactgtacagcacatattgcgcaccgacgtaacgggccaaaccgatcgctttactgcgcgagccaaagctatcctcctcagataaccccagcgtctgtttagcgacgcccagttgctggggtgagatcagcacaaactttttatttgatgacaggacttgatgcaacgcagcagtcgctttcgctgtttgcaatgcgccattagtattatttttaaccgaatccaccaacagtatgctacctgtcgctacctcatcgctgttcaccatttgggcaaccagaggttcaacactgacagcccagtcaattgactgcactttcggtggctgcggaacggtatctaccggcggtggcacctcaacatccggtggcgttaccggttcaatggtcactggaggcgtcggcgcgacagaatccggaggaacgcaacccgtcagcaccagtgcggccagcgccagagataaataccttttcattgttccactccaataacgtgatcataaaaaaaccaatccgttataaaaataaatagagacgcgcactgcgcgcattaaaattattgttaattgactgaatagccacatcatcacccggtgcgatcacaatagaacgcgttgcttccagtggccggacatccagcccctgcgcatcataccaataaaaacgatagtgtatttttgccggtatgttccgactgttactgagcaccgagcgggcaacatttttacccgaggaggcggagatcaccggttgggaagccagaataccggccgtcagtaccgatggatccatcacgacagtttgctgtgggttaaccgcgatcccttgcgggctgctgcaccccagcaatgttgttacgcaagcgaacaatatcacgggtaatagcaacgttttaagatcgcgcataagttgacctctgcaaaacttacttattatagggctatttgtggggcaacaaagggccaagctcacggccaccgaccaaatgcatatgaatatgatagacaacctgcccggcatggtggttacagttgataattaaccgatagccgtcttctgcaataccttcctgctcggccagcttagcggctacggttaccatacggccaagtgccgcctcatgttcagccgtgacatcattcactgttgggatcaaaacattaggaatgattaagatatgggtcggtgcttgtggggcaatatcacgaaacgccgtcaccagctcatcttgataaaccacatcggcagggatttcgcggcggataattttgctgaaaatcgtttcttcggccataacacatttccttggtcattataaaattgaagaacatgcagtatgagcgacaatttctattggtttcaacctgattagacattttccagggcgaatgacacacaaccagcccaaacaccccggctgactaacctttctcactgacattaaggatcgcggactgcgcttataaatcagcctcttgcataagctgcggcttgttcaaacagcgcctgacttgggcggataccggtgtataacacaaattgctctacagcctgaatagcaaaaacctcggcaccggtgatcactgtttttccctgagtctgagcatagcggataagcggggtgacggcgggcaacgccacaacatcaaaaacaattttcgcgcggtccacttcagtttcagtaaaagccaatttatcagcatcagcccccccagccatgccgactggtgtcgcattaatgagcatatcagcctgaatattctgcatatcagggcgatagatgtaaccagattgctctgcaagttgcttgccggtcttttcattggtggcgataatataaccctgtttgaagccagcatttttcagcgcaaaagcaacggctttcgccataccgccactgccccgcaaggcaaacacgttatctaccgggacctgatactcctgtaacaatttggcaatggcaatatagtcggtattgtatgctttcagataaccgccagtattaaccagtgtattcactgagttgatcgctttggccgagggatccatctcatctaccattggaataacagcctctttaaacggcattgagatcgcgcagccacggaaacccaacgctcgcacaccaccaatagccgcagccaagtcgttggtggtaaaagctttatacaaataatcgagatctaaagcatcatacaaaaagttatgaaaacgggtaccaaaattgctgggcctggccgcgagggaaatacacactgtcgtatctttgtttaagtaccgggtcatcttcttcaccttgatgtcaatcgcgtccgcccactggctcccattgtagcgcgagagcacaacagacgatgaaatgcttgttgtggtaaaaattatggactaaaaagaggatattaaaaactacaggtagagggaaacatcaatttaattgatttagatatgaatcaatatgagcaattcctacaggcgtttaagctggaagatgaagacgggaaccggatttcgctggttgataaatacgatggcagcattgctaatcccgcgatccgccgctgcggattaatgacccgaatgcgcggctttgaagatatcgcggagcaagagaatttagccggtgacacgttaatttcgccatcgaaattccattccatgcacaacagtgacaaacgtaaccacaaatggcgcagtgcctggccgtctcgttagcgtattcgccagttccagcaaataggtggggcgcaggttgccgctgacaagggcaactgggcgggtgacaccctcgcacaaggcggcccgttagtcgcccacaaagatttacgcgtaaagctcacttacgacatcaccgagaacggcaatgattacggggataacgtcagccggatcaccggcatctttgcccccgaatcaggttctaattcaattatctatacccgtaccaccacttacaaaattgtccctaaaattaaacctgacgcggatttttctgttgacgttcagggcggcccgccgccccttggcgttctgtctataactgtacactgtagcgatcctcaaccgacaaaatcggttgaaagcaccccgcctgccgcagaatttagttatccaaaactgccaaaaaatgccacagccaagcagataaaacgctatcaccagcaaaccagcccgctttttgagggtatggggcgtaaagaacggcaagaactggccgaacgtatccgcaatgatgggagtaaagttggaaaagtctctgataatcgcgaggtgaatcaagcagacataactgctcagtatcaacctgtcggtgagttagcggagcaggtgctgattttcctgcgaaaaatcggcatagagccggagccgtgagaattgcgggcgttggtgatggggttaaggtggattttgggggtgacggtttattcatagtcagcaaagggcgattactggcagtctaagtacatatttgttttaaactgccagcaaaattagttacgttctaagaacatctcatgctcttcaccagggaatttgggttcccaaatcatatcatttgaatctcctacatacttatattcagtcgaggagaacacaacttgaaaaccatatttcattgataaaactttcagttcattcatgaatttatcaatatcttcgtaatgtgtttcatgctgttttggtgtgtcgaatattataaatttaaatggcattttatcacctacacacataagttccactaatgcagccttataagcaagaatagctctaactcgagtacttcctttaagttgcgttagtacttcactacctagattaggataaaaatcatctttaaacgttatatttttatctatattcagagtatttaatatctctagccatttaatataagctagtttaaggtctatttttagctttgttactctaggtataatacccttacctttctttaaagtttcaactctatcttgagccaactctcttttatttaaattttcaaaatatttttcttcaagcattccaactttctgtaactcacttttttctagctgtagagtaaagatattagcagttataatggatattgtttcaacaattgatgatatcccttcactttttgctatctgatctctaatttctagaatttcttctattagtttttttagtcgtgtctaactcactttttattttatcgacagaatgactatcaagctcaatatttctctcgatatcttttatttggtctctcaaatatagaagattctttccataactttctgagctttgagaaaacatcttacatccatctgatggacatatctctttgaatgacctgaatacccgtttggcttcctcatttatatttaacgtatttatctctatatttatctcatcttttattttagctaaactaattttccgtcgattaatatcatcaagctcatcatttaaaattctgattctttttttgtgcgatgatattaatacattcatgctagataatgcatcatttttattattgctatcatcttttaaatcgcttaactctctatttaaattagagatggctaagtctatatcctctagctttctatttacatttatttcacttcttgctagttcaacttctctacgctgaactaccaaaaccttatcaaggtattctaattgtgcctcagcatcaattagttctttttttgaaatgaacgagtttctttctggcaaaccaaaaataactcttaacatttcagaaaactgatcttttataaaattattatgtgcagaataatatctggagtaaccatcatcttgatctacatagaatataggaagtaatgttgacaggtatgggtgtgtttgttcatttttaatagtaactaatgatggatatggaagcttcaataatccaataatatattttgagtaagttatttcattatgaaaatgttcaacctgaccattggaaccaaccaatctaatatagaactctttctgcttaaaatctcgtctagatgtatatttctcaccagaaatttcaaattcaagctgagcatattcacaaaagttataaatatcatcgcggaatttacaaggatatcccagacaataaactactgattgtaacagcggtgttttgccactaccattagggccaaaaagctctgttatttcttttgcgaaaatgagaacctctgactccaagccacttacagcccttccttttaaaaataagctaacaagtttcataaaagttcaccatctaattttttatctacgcagaaatttctataagaccgttcaacctgccctaagttataggataaatcaccctcgtaatctatggccctatcaataatttttttacctaaatcagttatatatagcttcccttctttttcattaacatatactaagtctactgattctagaaaattaacagcagtgacagtcctcattctaagattagccgaccaacctaaatattgagatgaacctttgaaccctctcattgtatcttccaataactttcctacaagttgaccaatttcacttactattggtttccttctgttttttgacataagaaggataatcattgcaattaatggtaattgaaataatgcttcgttatctaatccggctggcactctattaccgactgggttgatacctattgaaacatcattactttcaacactatttaagaactcttcataattcatttttcattcctaaccagttgcgaaaaaatgccaccgcaaattaagtcattatttaaatcataaactatcttttctttttctaatttatctataagattattcatcaaagttctaagaaggcttaatctaacgatattccttccacgggacaactctgaaattatatcgcctatatatccttctataacggtgatatcaatagcaggtaaaatatgtcggttaattctcaaccacccatcccatttggttttacactttgcacaatattctacttcatcatccttcgcacctgctcttcgcaacatccgttcaataacagatgctgatttaattgctttttcatcaccacctttaagaagttcgtaatacgctacttttgatatacttaatacacttaataaatcatcaattccaacaccactagcagataaaagactatccttagtgactgatttaattttaacacttgattttgagttaactaatgattgaagtgaaataattatttctttggcttccacgtattgaagatcaatctcgctatacttataaatcacatcttttgctaatgactcaaaattattattttggctttttatatattgaacatcagagttaatgataattttcttgagattaactttaatttgctcatcagttaaactcaaggcaggtgaaaaaaaaccattgaatttttcaattaaaaataatgtgtgcttattactaaaatcttcatttaataaatcagtaacaaccgcgtcaatatcttcgttaacatgtgtattagtcataaagataatattttcacatgtttcaggaaagttaactgtatgctgtattagcttaccgataaagctattaacaaccttttcatctgtctgaggtttttttttactattcctagtgagaatgccaaaaacatcatttagcttccatatgtcacttaatttatctttcgttttaacttgaacaaaagaatatgcaattttacctaacttattcttttcaataacaaaatcatcatgaaattcacagtaaactcttacaacatcctttccttctaaaattgataaacaagcaatactagcagctcttacttgagcattatatctctctaacgtatctcggccagcttgctctctaggcttaatctcatgcaactcattcataatcatccacttatctgagtgtacaaatagtaacttagtgtccaaccatcctatattggatttaatacttagtaaccagatagtaaagtaatatttatgataagtgtgtgtatgctcaagtaattaaccaaccttttcgtaaatattaccaatcaactgtatataagtacagtacattttgctatgatacatttaataattatctcacaatatttttgatgctatttacccccttcaccccaggcctgccgccaaatgcacaacaaaaagacaccttttttgtgtgcaggcgtggaggggagacaatcgcgcgctgatgggtctggaggagatcagacacctgcggctgactcgcctctcgtgggtcatggtgatgtgcattcgtttgatgggtgtagtgatcggatgcatgaggcgtgcgcctcgctatgggtcgcacagcgcgtgatcgaggaatgccacgggtggcaaggtgcgcccgtgctgatgtggatgaaaattattgaatgaatcagcggttcaggctttgacttcggccagtgcgtaggggttgaaccggaatacctcgacaccgagccagtaattcagggctttcagaccttccatgatggggtaccgctcgttaatggcgaacaccttcgcgaccttctcgacatccccaaagccgctggtattggtcggcatgatccccatcagctgtggcgatacgcggtgtgcggccagcaaatcatcgcgggttacgttcttgataccgttaaactcatctttggtggttatctcactgaaaggcatgatttgcaggccgtctttcttcccacctgccgcgtacacaaatacgtttttgaatgcccccttcactctggcatcggtcagggggcgctttagcgcctgcacattggtatcgctctgcatggcgtcagacagataaacaatcaccccggcatgacttgccgttaatataatacttgcgccggaacagcgtggcgtcctcattgagcaacgccgacgggatggcggctagatggaacaccgagcgaggcgcaaaggcgtagtcctctttctcgtaaatcacaaatcaatactgatccagattgctcccgcgctgcatgtacttagccggaacatgcttcagcgccagcgggccgccccgcagattcttgcgcagttcaagataggcattaccgaacaccagaaaatcctgcgccaacgccccgccttcatcggggccgctgattaccgtcaatggctgtccgaaggtcacgctctgcccgttcccggcagcaaacccactacagattaggttttaacatcgggcgttctttgctggcaggccagtacgatatcgatctgcgccgcacaggcgtgtaaagctgcctccaattggtcgatatcgtcgctcaagtcaccgttagtgagtcaggcgatgccttacctgcggagcaatcccgataaactggctatctgactggataaaaggacggtggccgctaccgggcaaaagtcgctgtcattcgaataccgctacaccgccatcagccagattagaatactttttcaatatgttatactccgcccaaaataaaggattaacatttaattaaaggattaatatgcagaatggattatcgaaacctttatgacaatggcgctaaagcactccttcactgctacggtgtcggctcattcgaggttttctctggtaaaaaacctttcgtcaatgtgtctgaatgttcagatattcccctcgctgcattacctccagggcaatattggattgtcgaccgccctacgggttatttaggaaataaaattcggcagaaaggtttggatttatagtggggtaccgaccacgatagttggtttggcttattcagtttccagactatgaccgatagcctttatgtcaatggcatacaacgtggtcagtttagattgcatccattaagtccggatggttccggcgaatcatggggttgtattaccttctttaagggtagtgattttgagatcgtcagtaaggcgattagacgccagaagaaattccgggtaccgggccatcatgagttaatggcttacggacaggttgatgtaacagggagcacaaattttgacttctgcaagcttcgctagaacagtaattacattaatcctattcattatatgctttagcgtagtctttctatttttccaacagatgaatatggtgaaatcgttcctttacgacttatcagtacatattggcaatttaatcggtcatatgggtgaagatagtgaaggaagctggattgagttttatcttgttctgctatttttattagctatcacgagtctaatttatatgtgtctgactcgctatttgttcaagaaataatactgcgccatactagaacccccttctaaaagttgtctcagtccccctacaactgccgcgcgttacgcccctgcccgcgcccgttacgctgaataacgagtattgaccgccatgaccaacaccgaaatctatcgcctgataatgaatctgatccgtttcggtcaaaatcacactgttttgtatttgaaagtggtcaatctttgagtggaggtcatgatgtgtatagtgaaaatagataactcaataaaatcaatgtgaaacacacaaaaaaaggaggctttcgcctcccttttgctctcccctaacctgaattaatggttacgaatgtattcgtccatatcagttttcaggttgtcagatttggtaccgaagatagcctgaacaccagagcctgccacaacaacacccgcagcacctaacttcttcagcccagcctgatcaaccttggacacatctgccacgctaacacgaaggcgagtgatacaagcatccaggttagtaatgttgtctttaccaccaaatgcttcaaccagagcggctgacatttctgtgccaccctgtactgattgctcagtagacgaatcttcacgtcccggtgttttcaaattcagtttagtaatcaatacacggaagatggtgtaatacaccagaccgtagcagatacctaccagagggaacaaccagatacggctgctgttaccgctcaggacaacaaaatcaatcaagccatgagagaaactggtcccatcacgcatccctaacagaatacagattgggaaggccaaacctgccaagattgcatggataaaatacaaaattggtgccacgaacataaaggagaattcgattggctcggtaataccggtcaggaatgatgtcagtgctgccgagatcatgatcccgcccacttttgcacggttttctggtttggctgaatgccaaatcgcaatggctgccgctggcagaccgtacattttaaacaggaaaccccccgataacttacccgctgttgggtcacccgccatataacgtgggatatcaccgttgaatacctgacccgctgcgttggtgtactcaccaatttgcatttggaatggcacgttccagatatggtgcagaccgaatggtaccaatgaacgttcaacaacgccgtaaataccaaaagcgacgaccgagttctgataagccgcccactcggagaaaatttggatagctttgccgataggtggccagatgaaggacagcagtatgcctaagaaaatcgcggtaaacccggagataatcggcacaaaacgtttgcccgcaaagaagcccaaatattctggtaactgaatacggtagaaacggttaaacatataggcggcaaccgaaccggcaataatcccgcccaataccccggtatcagctaaatgcttagtcgcaatttcttctgctggcagatgcaagaccagaggtgcgactaccgccatggtttttaccatgatgccgtaagccacaaccgccgccaacgcagatacaccgtcgttgttggtaaagccaagcgcaacaccaatagcaaaaatcaatggcatgttagcaaagacggaaccaccggcttctgccattacgtgagagactaccgacggtagccagctaaaattcgcggaaccgacacccagcagaatacctgcgatgggcaacacggataccggtagcattagcgatttacctaccttttgcaggtttgcaaatgcgttcttaaacatagttgagcgtgctcctgagtaatagtgcttttcttgctgtttttcgcgttatgggcattacaaaggggggagtatgcctttgcgaataagggtgtctaagcacccctttaatttttacgaagagtaaaataaatagattacataatgtttgattgccgtcacgtttctttcaagaaagcacgtaatccctctcggatttcgtactttacgtaaagaaacgtcaataataaccgccatcacccaataaattgggtgagaacattacttctttcggcgattaattacgagctaaaaaaaaagtattcttatggaagcgggcgcttctcactggagagtgttgaagggtctagatgaaataaccggcagaagtttgctgtcgtcgcttcagccagcgattcaagacttacccccttcagcacagccatatattctgcgacatcacggacataggcaggttgattctctttgccacgatgaggaacgggagccagatacggtgaatctgtttccaccaacagcctatcgagtggaacatagcgcgcaacatcacgcagttgttcggcgttgcgaaacgtgacaatccctgagaaagagatataaaagccaaggtccaaaagcgttgctgccgtggctttgtcttcagtaaagcaatgtaagacaccaccgcaatcctgcgcctgctcttcgcgtaaaatcgacagggtatcttcccgtgcatcgcgggtatgcacgataaccggtttatttaattcgcggccaatacgaatatgctcacggaaggaagcttgctgtaacgggatgttatcttgctgataaaagtaatccagcccagtttcccccatcgcgacaacatgagtgccagcagctaactctctcaactgctgaaaatcatagccaccgtccaagttgagcggatgaacaccacatgagaacgccacattcttacgctcaccaatcaatgccgtcatggcggtgaaacccggcaaggtggtggcaacagccaaaataaagcccacatcacgcgcattagctttggctaatacgtcatcgacactgctgtgcaatgtctggtaatcaaggctatcaaggtggcaatgagaatcaactaacaacataatattaaactcttttacaacgaaggtaaggtggaataagtacccgtggacagtgctgtttcccagctaagcagttgctcagtgagtaacaattcacgattaacacctaccacagataataattgatggcggcaatgagccagttgcttagccaactgaagtaatactggcgtcgccgcgatgtgtgccaactgttgcactaagggtaattgatcctgattaaccacaaactcccctgccccttgctgccacttcaacgcatccaagagcagtgaagagagccattgcagacgttcagcagcatcatcatggttaagttgtggtaacaacgacagcaagtctgagcggttcagtgcctcgcgtagcccgctacacaaagcgctgcggatactccagcgctctggttgaagcaaccgctcagccgccagcggtgcgccttcactcaatttcagggccgccaacatcgcaacgggctccacagggatctgccgcttacgccattgcagattgagccattgcagacaaatagccgtatccgggcaagccagataccaataaaaacagcggctacgcagtgtagccagcaagctggcgggttggtggcaatccaacagaaaataggtcttctctggaggctcttccagcgtttttagcagggcattagcagcggcatcggtcaacacttcggcatgtggcaaccacaccacctttgcaccgccttgttgagcatgggaatacagtttatcaatcaattggcgaaccaactcaaccccgatactgcttttgcctttttccggtgtcagtacataccaatcggggtggttgcctgccaacatcaagcggcagctatggcattcaccacaactcttctcaccttgccgctgctgacacattagccaacgactcagcgcataaatcaatgcgtcttcgccattaccgggtaatgaatgcagcagtaatgcatggtgcccgcgcccggtactgtgctgcccaaccagttggcggtaaggggcgttaagccacggataccaattcattacacgagttcctgattggtcagccactgagcgagcgcctggcttatcgacgcactaacttgttcaatgggttgggaggcatcaatcgttttaatactggcatcactggcggccaattcaaggtaacgtgcgcgggttcgctcaaaaaacgccagtgactcttgttcgatacgatccaattcaccgcgcgcacgggctcgcgccaaacccacagccggtggcagatccaaatataaggtcaggtctggccggaattcgcctaacaccgtgtcacgtaacgaggccatcagttggctgtcaatccctcgccccccgccctgatatgcctgtgatgacaaatcatggcggtcacccacaacccaactgccacgcgccagtgctggcttgatgacattttctactaattgcaccctggcggcatacagcattaatacctcggctttatccgtcaggacctcaccgtcaataccttgcttaatcaaatcacgcagtttttccgctaaaggggttccccccggctcacgggtaaaaacgatatcgttaatcccttgggcccgcagcaccgcgaccacggtgtcgcgggcggtggttttccctgccccttcaagcccttcaataacgataaatttactgttcatttttatcctttagcgactggcgataaacacgcacggcttgattatgactggctaaattagtggtgaatgtatgcccgcccttgccgtctgcgacaaaatagagatagggcgtttgggccggatgggcagcagcggtcagcgatgccaaccctggcatggcaatgggggttggcggcaaaccggaaataacataggtattataaggtgtcggggtatctaagtctttacgagtaatgttgccgttatacttttcgcccataccataaatcactgttggatccgtttgtaggcgcataccaagacgtaaacggttaatgaagacagaagccaccttatcccgctcctcatttaccgcggtttctttttcaatgattgatgccatagtaaccaaatcacttggggtcttatacggcaatccgtcatcacgcccctgccagatttctgcaacggttttctccattcgttgatgggcacgtttgagcagtgttaaatccgttgtacctgcggtataggagtaggtatcaggatagagccagccttcggggtgttcactctcttttaaccccagtaactgcgcaatttcagcatctgttttcccttccagcacatgtttgatatattttgactgttgtaattcatccagccaatcacgcaggcgcttaccttcaataaaacgaacggtaaactgggcttctttaccactgaccaacaactccagcatctcacgtaccgtcatacccggcgtaaaacgatatgtcccagccttaaaattagccagttcgggttctatgcgcagtagccagggaaataaacctgtattagcaatcacatgatcacgtagcaataaattctctagagcaacccgcccggtacctaccggtaaggtaaagtaagtctcttgcttaatcgccaagggctgacgcgcaaaatcttgtactttttgataacccaacagcagtaatcccaaacagatcacaacaaaaaggatcagtgctttggtgctttttcttttcatcgggtggccatttttaaatttgaatgtggcggttttaaattgaatgtggcggcgttctaaaaacaagcgtgattatataacaattaatcagactgctgacaaaccccgatgacgcgatcttgaacggtgaggatagacagaggagtaaagcgtccgcgccaaggatggcgcggctcgagcctacatggatgtatttacggcgtctttacgatctgcctgttctctccatcgcgggcactttgtcaataacctcaattaattatatctatgcatcgcaggtatcatcactcatatatcgcagcaatgcaggtttaataggtcaaataacactctcgatttgtatacccatttacccaccttattgaccggcagtactggcatcaatgcgttacaaacaataacttcatcggcatcggccagtacattcagcggctgcaccacaatttcaactggcatattatgagccgctaaacaggcaataatccgctggcgcataatgccatcaacccccgaatggctgagatctggagtacatacctggttgcctttgcgccagaataaattagccgcacagcattccaccagctgacccgcagtgtcaagtaccaccgcctcctcggcctctgtctgttcaagatgtgcgcggatcaatacttgttccaaccgatttagatgtttgataccggccaataatgggttgcgcgccagaggcactgggctaagagccaacgaaataccgcgatcccgccaggtggaataatgggcaggatagccactgagcgaaatgattcgggtaggatgctgacatgccgttccgctatagcctcggccaccacttccacgactgataataactttcagtacgccactctccgtatgacttgctgcctctaccatttctttggtcaatattttccagttgaccgtgggcagtaatagacgttcagtcgcccgttgcaaacgcagcacatgctggtcaagccaaacaacccgcccatcggatacacgagcagtggtaaaacagccatcaccaaattgtaccgaacgatccgaagctgaaatcaaattttgctctacaccgttaatccaaaacatttcagattctctttagatgggatgtgtcttgtttgtcatataattagccgccagacattcagttgccatgtatttggttgctctgtatttaacttatacactgacaatatcagatttaagttgaggatttaccccttctgactggttgccgcagtgcgaatcgctgtcacgcccccaaatcactgacgggtgcatgcactgggaatgtattcgtttgctgtttggctgcaacaccgcagactgtgaatatatctctttgtgagacactgatgatggcgggatgtttgaatgatataagatgaatttaataaaagacccggaaaaaccgggcctttttagcatcagaaccttaacagccacggttataccttacggaataccaaagagccgttagtgccgccgaaaccaaaggaattacacagggtgtattccatatcttttacttgacgcgcatcatgcggaacataatccaaatcgcaaccttcatctgggttatccaagttgatcgttgcaggaatagcctgatcacgcagcgccaacacggtaaagatagactctacggcaccagctgcacccaataagtgcccagtcatggatttggtggaactgaccataactttataggcatcttcaccaaatacagacttaacggcctgcgtttcggctttatcgccagcaggagttgatgtgccgtgggcattaatataaccaatttgcgaggttgtgatgccagcatcacgtaatgcattcaccatggccaaagcggctcctgaaccgtcttccggcggagaggtcatatggtaggcatcgctgctcataccaaaaccaacaacttcagcatagatttttgcaccacgcttcttcgcgtgttcgtactcttccaacaccatcatgccggcaccatcacccagaacgaaaccatcacggtctttatcccacgggcgacttgctgcttgtgggttatcgttacgggtagacaatgcgcgggctgcaccaaaaccgccgacacctagtggtgtactggctttttcagcccccccagccaccatgacatcagcatcattataagcaatgatacgtgccgcgtgaccgatattatgtacgccagaagtacaagcggtagcaatagatatgcttggtccacgcaggccatacatgatagtcagatgaccagcaatcatgttcacaatggttgaaggcacaaagaatgggctaattttacgtggcccaccgttcaccaatgcggtgtggttttcttcaatcagacccagcccgccaataccagaaccgatagcggcaccaatacgggaagcgttggcttctgtaatgtcaagcccggcgtcttgcatagcttgcatgccagcagcaacaccgtactgaatgaaagcatccattttgcgtgcatctttacgcgaaatgtaatcttcacaattaaaatcttttactaagccagcaaatcgcgttgcgtaggcactagtatcgaaatggtcgatcaggctgatgccactctgcccggcaagaacagctttccatgtggattcgactgtattaccgacaggagacaacatgcccagtccagtcacaacaactcgacgcttagacacggttgtcctccagggagggaaaataacacttcggacaaaaaaaacttaggcggtcgaatgaccgcctaactatctaaacttaaagcatgttcgcttactgctggttagcgttgataaaatcaatagctgcctgaacagtagtgattttctctgcttcttcgtctggaatctcggtatcaaattcttcttccagagccattaccagctcgacggtgtccagagaatccgcgccaagatcttcaacgaaagaagcactgttcttcacttcgtcttctttaacacccagttgttcaacgatgattttcttaacgcgttcttcgatagtgctcatactcttaaatttcctatcaaaactcgctttcgcgatggttttcgtagtgtataaaatgttgaaaaagatgcaactaaatctcggctggtcaaaccacgattttacgctattttgcggtttttacctcaaataacgcaaatactttcgtgatttttaaatcatatacatgccgccattgacatgtaacgtttcaccagaaatgtagctggcctcgtcagaggctaaaaatgcaacagcgctggcgatttctttagcatccccaagccggttagctggtacttgggctaaaatgcctgcgcgttgatcatccgtcaacgtcctagtcatgtccgtctcaataaagccaggtgccacaacgttgacagtaatgccacgtgaagccacctcacgcgccaaagacttgctaaaaccaataactccagctttagctgccgcgtagttaacctgccccgcattgcccattgtcccaacaacagaccctatggtgatgatacggccaaatcgctttttcatcatagcgcgcattaccgcttttgacagacggaatacggaagtcagattcgtgtcaataatatcctgccactcatcatccttcatacgcatcagcaggttatcacgcgtaataccagcattattaactaaaatatcgacttcgccaaattccgcacgaatcgttgccagtactgtgtcgatcgaagtgggatccacaacgttcaacattaaaccttttccgttctcacccaagtaggcgctaatagcttcagcgcccttctcactggtcgcggtaccaataacacaagcaccgcgttcaaccaataattctgcaatagcgcgaccaataccacggctcgcgccagtgaccagtgcaatttttccttcgaagctcatgttaccctctttcttagtgttcaagcgcactgttcagcgtgacaacatcgttgactgccgctgcagccaatgaatcaacgatacgcttggtcaggccggtcaatactttacctggcccaatctctaacagcagttcaacaccttcagctgcaataaattcaacactttcagtccaacgtaccggattatacagctgacggaccaatgcgctacggatagcgactggggacacctcagctttcacatcgacgttgttcaccactgggaagagcggctcctgaaaatcaatcttctcaagtgcgactgccagcttgtcggccgcaggtttcattagcgcacaatgggaaggcacactgacaggcaatggcaaagcccgctttgcgccagcggctttacatgctgcgccagcacgttcgacagcgtctttgttgccagcaataaccacctgaccgggtgaattaaagtttaccggtgacacgacctggccctgggctgattcttcacacgctttggcaatggattcattatccaaaccaataatggcatacatggcaccggtaccttcaggtaccgcctcctgcatgagtttcccacgcagttcaaccaagctaacggcctgtttaaaatccagaacaccggcacaaaccaacgctgaatattcacccaaactatgacccgccatcagtgatggcaatttgcccccctgatgctgccagatacgccaaattgccacagatgcggtcagcaatgcgggctgtgtttgccacgttttattcagctcttctgcagggccttgttgtactaattgccagagatcatagcccaggacagacgacgcttcactgaaggtcgcttcaactatcggaaattgtgcggccaaatcggccagcatgccgagggactgagaaccctgacctggaaataccattgcaaatttcgacattttgcattcctgttacatcaaaaaacggccggttaaatcaaaaacgaaccagtgcagaaccccaggtaaatccaccgccaaacgcctcaagcaataccaactgcccacgttgaattcgcccatctcgcactgcttcatcgaatgccgaaggcactgatgccgcggaggtgttcccatggcgatcaagcgtgatcaccactttatccatccccatgcctaactttttagccgtagcgctaataatacgcaggttagcctgatgtggcaccaaccaatcgagcgcagtgcgatccagattattagcctgcaatgtttcatccacaatgtgggccagttccgttaccgcaactttaaaaacttcattgcctgccatcgtgacgtaggcaggttggtcctgctgacggtctggatacggtaaagcgagcaactcgccataacgaccatcagcatgtaaatgcgtagacataatacctggttgctcagatgcaccaagtaccaccgcgccagcgccatcgccaaacagaatgatcgtaccacgatcttctggatccaatgcacgggacaatacatctgacccaataacaatggcatgcttgaccgcaccactcttaacatactggtcagcaacactcagcgcataggtaaaacccgcgcaagccgcagccaaatcaaaagaagctgcatctttgataccgagcattcgctgcacctggcaagccgaacttgggaaagcatggcttgaagaggtggtcgcaacgataatcaacccgatatcgtccttatcaataccggccatttccagcgctttttctgccgcctggaagcccatagtcgcgactgtttcgtcaaggcctgcaatacgccgctcacggataccagtacgagtgacaatccactcatctgacgtatccaccattttttctaaatcagcattgctgcgcacttgtacgggcagataactccccgtaccgagaatcttagtatacatgtacgatcagtcactcttgggtaataccgcttcaaggcgcgcggcaatccgttcaggaacttgccgctgcaccgcctgcactgcctgctcgatagctacggcgaatgcgcgttgattcgccgcgccgtgactcttaattacaatacctcgtaatcctagcagacatgcgccattatactggtcgggattcaaatgaccgaaccgctttgccacacgtttttgcagccagcgcccgatgagcttaagccaccaagactgtttgctgccttcgcccgatggtttgagcagtgataaaaacattcttatcacaccttccatggtcttgagagtgacgttacccacgaagccgtcacaaaccattacatcagtcttacctgtaagtaaatcattgccttccagataaccaatatagttgatcgccggtgtattttttaatactgcggcggcttcgcggatattatccaagcccttgttttcctcctcgccgatattcagcaaagcaacacgaggctcgactatcccaacgacttcttctgccatcactgaacccatgacagcaaattgcaccagcattgtgctatcgcactcaacgtttgcccctaaatccagcaccacggttttactacgccgctgattggggataaccgtcattaacgccggacgcgcgatgccttccaatggcttaatcatcatcttcgccaaccccatcaacgcaccggtattccctgcactgacacaggctgcggcttcaccgtttttaaccagctccaaggcaacacgcatggaagtaccacggctggcacggatcgcttgtgaaggtttagcatcgctggcaataacatgctcagcagggatgacctgcaaccgctccagcaacaaagaatcggcattagcaagtaacggagtgatggtgtcgggattcccgaccagcaggagtttaagctgtggattagaggccagtgcctgcaatgaagcaggcactgtgacgcagggaccgaagtccccgcccattgcatctaacgctagggtcagacaagccaaggtatcgccttgctaaagattagcaagtactactcagccgatgaccttgcggccacggtagaaaccgtcagctgtgatatggtgacgcaggtgagtttcaccggaagttttgtccacagacagcgtggcagtggtcagtgcatcgtgtgaacggcgcatgccacgtttggaacgagttggtttgttctgttgtacggccattgaccttactccttaattacttttctttaaactggctaatacggcaaatggattgggtttctctacctctgcaggcagtttaccaaataccatgtccgcctcggacacttcacagtgttcagaatcatgtaccggaacgacaggcagtgaaagaataatttcgtcttcaatcatagccagcagatcgacttcgccaaattcatcgacttcgatcggctcgtacgcttccggtaatgcttcagcctgctcatcattgacgatcgggctgaaacaatacgttgtatgaacatggtgtgcaaacgtgccattacagcgctgacacatcaatgttacatcgacgtctgcatgacctgtaataaccgccagacgctgattatcaatattaaacgataatgaggccacgacatcgctgtccacacttaccacagagtcggccactcgtgtaacctgctcaggcgaatagatacctgcgtaatctaaacgtttctgagcggtacggaccgcatcaatggtcaggggtaattttaccttttgcatagggcgcgcatattaactttgtaacgacatagagtcaaagaaaaaggccgttttactgcacctttcaccaatattcgcttccgaagcggcgaacagtttaagatgcctgattaaattacgccatggtttatggaaaatattatgccgcaactggttcttgcttcaacatcttcatatcgccgtgccttgctggaaaagctccagttaccctttattactgatgcccctgaaaccgatgaaaccccacacgctggggaaccagcagaagcgctggtacaacggttggcatcagcgaaagcacaggcactggccgggcgttatccgcaacatttaatcatcggctcagatcaggtctgtgtgattgacggtaaaataaccggcaagccccttcaatattctactgccgtaaaacaattgcaacaggccagtggccaatgtgtcactttctatactggactcacactgctgaatacggcaaataacagcattaattgcacatgtgaaacctttgatgtttatttccgcacattgagccaagccgaaatagacggttatttactacgggagcaaccctggaattgtgcgggaagttttaaaagtgaaggtttaggtatcacattgtttgagcgtttagccgggcgtgatccgaatacgctcatcgggttacctttaattgccctcacccaaatgctgattgaacaaggcgtgaaccccctgacggtaaaacccgtcgaatgataaagccagccgaattgtaaaaacggtcgaattgtaaaaacagtcgaataaaaacggggcgcatgctgtgcaccccgccttttatgatcatctttagctgtaacaaattaagccacaacagattattttacggtggcgttcttacgcaaggccagcaaacagtgacgcaactggttatccaagggggcttcgatccgtatcgtctcaccggtattgggatgttcaaaacgtaatgcagcagcatgaaggaataaacgatgcagcccagtgccttgtaattgttgatcaaactcacgatcaccgtaacggtcatcaaaggcaatcgggtggcctgcatgtaaggcatggacacggatttgatgcgtccggccagtcactgggctggctttaaccagcgtggcatgttcgaaacgctcttcgattttaaagcgcgtctctgagggtttgccttcgctgctgaccttcacgacccgttcaccactttgcataatattcttcagcaaaggggcctgaattgctttgcagtgagactgccattggccccggaccaacgccagatagtctttctgcatactctttaagcgcaactgttcgtgtaaggagcgcaatgctgagcgctttttagcaaccaataagacacccgaggtgtcacggtctaaacggtgaacaagttccaggaagcgggcttcagggcgcaatgcacgcaacccctcaataacaccgaagctcaaaccactgcccccatgcaccgccgtccctgaaggtttattcagtaccaacaggtaatcatcttcaaacaagatacaatcagccaacgcggccactttatccagtttggcggatacctgcacctcttctcgttctgccacacgtaccgggggtacgcgcaccacatcaccgtcagccagtttatactctggcttaatgcgccctttattaacgcgaacctcacctttacgcacgatgcggtagatcatactttttggcacacctttcaatttggcgagtaaaaagttatcgatccgctgaccggcttcatcggcagagatggtgattaattgcactactggattattcgttttcatggtgcgcgattctaaatacaccgaggaattagcgccacccctttttctgtgcttaactgtcaatctggctattagaagataacgtttgcgtacttttgttgtttaatatgacaacgatagccgtcaacactgtgaatacagtaaaagaatctttacgtagacagataaagtcatcttgctatatcagtgtcagcaatggaataatgctacaaattctacgttgattctcgttagaccaagagacttgtggaataataaactttgcctgatcacacaaaaacgcggcaatggcgtaagacgtaatgtgaaatcaagcaattagcgggctgcgggttgcagcttggccggcaagtgggtaaagctctgttgtcttaaattcagaagctaccctttatataaaagcgctgtttttcagaacgaaacacaggcttaccgaaataatgcgcccctatgcaggcgacaaccgtgaggttgacggcttagctagaagactcggggccatcggtttacccggtcatgaggttattttgcccgcagttctaacgccaatgtaaaaataacgagtaagttaaagatgaaaagaatgttgattaacgcgactcagcaagaagagttgcgtgttgcccttgtagatggacagcggttgtatgatctggatattgaaagcccaggccatgaacagaaaaaagcgaatatttataaaggtaaaatcacccgaatcgaacctagtctggaagccgcttttgttgattatggcgcggaacgacatggtttccttccattaaaagaaatctctcgcgagtacttccccaataattactcttcccatggccgcccaaacatcaaagatgtcttgcgtgaaggccaggaagttattgttcaggttgataaagaagaacgcggcaataaaggtgctgcattaaccactttcattagtctggctggcagctatttggttctgatgccaaacaacccacgtgcgggcggtatttctcgccgcatcgaaggtgatgaccgcaccgagctgaaagaagccctatcttccctgcaattacctgatggcatgggtctgattgttcgtactgcgggtgtgggcaaatctgctgacgcactgcaatgggacttgtcattccgcctgaagcactgggatgcgattaaaaaagcggctgaaggtcgccccgcacccttcttaatccatcaggaaagtaacgtgatcgtacgtgcttttcgcgattacctgcgcccagatatcggcgaaattctgattgacaatccgaaggttctcgaactggcaaaagagcatattgctgcccttggtcgcccggatttcagcagcaaaatcaaattgtatagcggtgaaattccgttattcagtcattatcaaattgagtcgcagatcgaatcggccttccaacgtgaagtgcgtttgccttctggtggctctatcgttattgacacgaccgaagcactgacggcgattgatatcaactcagcccgagccacacgtggtggtgatatcgaagagaccgcgtttaataccaaccttgaagccgctgacgaaattgctcgccaattacgtttacgtgaccttggtggtctgatcgttatcgacttcattgatatgaccccggtacgccatcaacgtgaagttgaaaaccgtttacgcgatgctgtccgtcaggaccgtgcccgtatccagattggtcgtatctcacgctttggtttgctggaaatgtcccgtcagcgcctcagcccatcgctgggtgaatccagtcaccacgtctgcccacgctgtagcggtaccggcaccgtacgtgacaatgaatcgctgtcactttctattctgcgtttgattgaagaagaagcgctgaaagagaatacccatgaagttcacgccatcgtaccggtacaaatcgcatcgtacctgttgaacgaaaaacgtgaatcagtaaacgctattgagaagcgtcaaggtggtgtccgtgccgtgatcgtgccaaacgatcagatgcaaacaccgcactactctgtcctgcgcgtacgcaaaggcgaagaagtcccgtctctcagctatctgttgccacaactgcacgaagcagaaatggcgcaaccgctggaagaggccaccattgaacgtaagcgcccggaacaaccagcattggctaccttctctctgccaacagaagtgccaccagaggaggcccctaccgtagccaaggctaaacctgcggttgcaacacccgccgcggttagtactgacgtagaacaacctggcttctttagccgtttgttcagtggcttaaaaaatatgtttggtgcttccgctgaagcagaagtgcaacccgctgaagttgtaaaaaccgacgctagcgaaaatcgccgtaatgatcgccgcaatcctcgccgccagaataatggccgtaaagagcgcaatgatcgtactccacgcgaaggtcgtgataattccagccgcgataacaccaaccgtgataacaccaaccgtgataacaccagtcgtgataacaccaaccgtgataacaccagtcgtgataacgctaaccgcgatggcgctaatcgtgataattccaatcgcgacaacagtggccgcgataacgttagtcgtgaaggccgcgaagatcaacgccgcaacaacagacgtccggcccagccaacgacaacatcgcaagggcaaactgaggttgttgaagccgataaagcgcaacgtgaagaacaaccacagcgccgtggtgaccgtcagcgtcgtcgtcaggatgagaagcgtcaggcaccacaagaaatcaaagcagatgttgcggaagcccctgttatagaagaggtacaacctgagcaagaagaacgccaacaggttatgcaacgtcgtcagcgtcgccagttgaatcagaaagtccgtattcaatcggcaaatgatgaactgaatacgttggaatctcctgtcagtgcacctgttgcgcaggtggtggtggctgaagtacaagaagaagtgaagttactgccacaaattactgctcaaactgatgatgacagtgctaatgaacgtactaccaataatgaaaatggtatgccacgtcgttcccgtcgttcaccacgccatctgcgtgttagtggtcaacgccgtcgccgttatcgtgatgaacgttacccggcacaatcggccatgcctctggcaggggcttttgcctcaccagaaatggcatccggtaaagtgtgggttcgttatccagtgacgccagtcgttgaacaggttgtcgttgaacaggttgtcgttgaacaaatcgccattgaacaaactacaaccgttgagcaaacagccatcgtcgagcaggtcagtgtagcgaatattgtcactgcgcaattgcctgtagagcaggtgcaaaacaccgttgcagaacaagaatcgagtgcaactccatctgttatgacaacaccaaccgttgcggtaacactggccccacaacacaaaccggggggttcttcatcttcggctgctgcggttccaggccgtgcacctatcgttgctgcagtgcctgtcgttgctgaaacgactgctgctgaaacggttgttgctaaaactgaagccgctattgatgcggtggctgttgtggaatcgatagctgctgtggaaactgcaactgtagaaccggttgttacagaagaaccgaatgtcacagaaccggccgttgccgagccagcgattgaaactgatcctgtcgaagaaacaacatcagttgtagagattgctccaaccgttgaatcaacgcctatgatcgaagatacggctgttgtagtcgctgcgacggtggttgacactacaccagaaactgcgtcaaccgtgcaagatgatattgttgaagagacagtagttggagagacagcagttgaagcggtaaatatctctgaaactgtggctgaagagaccgcaataacggaacctgctgctgaagccattgctactcagcaaaccactattgcgcaggagaccattgctgaaccaacggttgaaaccgctattgatgtggttgcggtagtcaaacaacccgcggttgcgcatccggaaggggtggtgttcaaacacttcgcttcagcgccaatgaccaaagcgccagcacctgattacgcccctgaatcaccgaccaaaggtcactgggagcgtccaacctttgatttctcaggcaaaggttctgctgggggtcatgccgcggctacccaggcaactgcacccgcgaccaaaccgcaatctgttgagtaactgcagtattacaacgaaaaaaaccgccattctgaagtgaaccccatttattggacactttctctggcggttgacatggcctgagttcggtactgcaccggactcaggccgtttaattttactttgattctttcgttgttgtagtaatggatagactcatccaccgcttttttcagttgttctacattctcgtatttttcgttatgtcggcatatcgtttatcagaatactatttatcaagatattgctggcagccatcaagctatctgcttcacttttttaatctccagactttccagtttgccatcaatggccttaaccagttgcttaaaatgctctgttttattgtgcttttccaatgcttcatcggaagcccagcgttcgaaaaagacaaaagaccctttttgctcgctttcggtatggagatcatattgaagattccccttctcctcacggctaggctctataatctgatgaagcgctgctttaacctcttcaataaattcagtttttgccactatactggcgatgacacgaatttccatcgttattctcccatgctgaaaatttaatcagtgaactaccgttccatcagttatcctgacagacaccactatctcaaactccctctataagatgctttttttgtcttgttttcaacttaaccctaacaatcagatgcatcctaagcactttccgcatatccttagaccccgccggaaacattcctgtcacaacataaaaacccgatatctcatcatgactgcggagcctgtagaatgactgcacaaccccaaaccctaaaaattcgccgcccggatgactggcacattcatctacgtgatgatgaaatgctcagtaccgtattgccctatacctccgaagtattcgcccgcgctattgttatgccaaatctagcccagccaattacaacggttgccagtgctattgcttatcgggagcgtattttagcagcggttcctgcgggccataaattcaccccgttgatgacgtgttacctgactaatagccttgatgttaaagagttgaccacgggttttgagcaaggcgtttttactgcggccaaactgtatccagccaatgccaccaccaactccactcacggtgtatctgacatcccggcaatttacccgttgtttgaacaaatgcaaaagataggcatgcccctgcttattcacggtgaggtaacagatgcggccgttgacatctttgatcgtgaagcccgttttattgaccaaattttagagcccattcgccaaaagtttcccgaactaaaaattgtctttgagcatatcacgaccaaagatgcggcagattatgtgctggcaggcaatcgtttccttggggcaaccgtcacgccacaacacttgatgtttaaccgcaatcacatgctggtaggcggtattcgcccccacttgttctgcctgccaatattgaagcgcagcacccatcagcaagcattgcgcgcagccgtcgccagtggttctgatcgcttcttccttgggaccgattcagctccccatgccaaacatcgtaaagagtcatcttgcggctgtgcgggtgtattcaacgccccagcggcattgcctgcttatgcttccgtgtttgaggaactgaatgcattgcaacatctggaagcgttttgcgccttaaatggcccacgattttatggcttgcctgttaatgatgacgttgttgaattggttcgcactccattcctgcagccagaagagatcccattaggcaatgaatcggttattcctttccttgcgggtcaaacgcttaattggtcagtgaaacgctaactcatcaagattacagcaagcgggcgcatcactggctttgttcagtggtgcgtacaacggcaacctaaacatcaaaataaggcgagaggtagtgacaactttatagcgaggtgatcgaagggataaccgcacttggtgccattttggcggcgattctaaatactacggccctaacgccacacgtctcctttatctgatattgtcagcctcttggaatgacgcccctccatctcaacatttttatatcagtctcttgtcgcctgaatgtttatactgtataaataaacagcatgaatattcggaggaccaattatgcgcgttgaagtcagtattgataaaaaaaatcagttgcccgcaggtgctatcgaagcactcacccaggaattgactaaaagactcaatacaaaattcccggacacggcgacggcagtacaggtgcgttatgcgagtgctaataatctctccgtattaggaggtgccaaaacagataaagacgtgatctctgaaatattacaagaaatctgggaaagcgctgacgactggttcgatgcggagtaagccattaccgccgtcatgctgaatctgtaagtcattcttggtggagcctgtacataaatttgtgtcattacctggacgctggcagcctttatccagccaccttaagtaagtttaaactgttattggggacaggctcctccttggggcctcactctgtgaactaggttaaaatcggttgccgccttcctgctactcgaattatttagagtctataatgctatttactgcattctgagcaccacaataccattttgccggggagtcgctcctcagccttttttgcttaaaacaggcgagtttcccttttccatcagacatattggtcatttttcccttcaactctacattgactaattaataaccataaaataaataatttgtaaatttttttgtatagtctccaaattcattggcggttgagtatactaaaacagctcactcggtaatgagccgcattgatcctcgttagtcactcaagccagtaactactatataaggggtctttatggacagaaataatgaagttattcagactcaccctgtcgtaggttgggatatcagtactgtagatgtgtacgatgctatgatgatacgtcttcattacctgtcttctatggatcaaccacaagaagatgcgttggttgatagaacgctctggcttacgaccgatgttgcacgccaattaattaatatattagaagctggtattgctaaaattgagtcatcagaatatctggatatggaccaccgtaagcactaattttttgtccatcaaatcatttttttattacccataaacaggcaccagtaaatattatctggtgtctttttattaaccactccctccctcatatggccaacatctctttttctccctcctatcccgtgttattactatcgttttaattattatcatcgctgtttctatatatacccacagtcactggtaccccaaaaatcattggcgttgcaggtagacagatggcgatactccctcagggtacaaaaacatggattatgatttgattgttattggcagcggttctgttggttcagccgcgggttactatgcttctcaggctggtttaaacgtgctgatgattgatagcgccatgccgccacatcaagcaggtagccaccatggagagacgcggatcatgcgccatgcatatggtgaaggagagaaatacgttcctctcgtgctacgagcacaagccttgtgggaccaactggcagcacagaccggcgaaaaattatttcaggcctgcggagtgattaacttagggcccgataattcaacttttctgcaaaacgtacagcgaagtgcccaacagtatgatttgccagtagaaaccttaaactcaacacaaattcgtgaaaaatggccagtatttactgttccggataactatattgctgtgttcgaaccacaatctggctatttgcgctcagagttagcggtgaaaaccttaatcaaagcagtcactgaagcgggttgcggtattttgtttaattgcccggtaacggctattgagtcacaccaagcaggtgttgatgtcgtgaccattgatggcacgtacagcgccacgaaagtcgtggtgacagcggggacatgggtgaaagaactgctaccgacattaccggtgacgccagtacgcaaagtgttctcctggcatcaggccgatggtcgttacagtgaggccaaccacttcccagcatttacggtagaaatgccagacaatatcctctattacggtttccccgctcagaatgacgcgctaaaactcggaaaacatcatggtgggcagctaattgaatcggcagcacagcgtaaaccttttggccgttatgctgaggatggcaccgaggtctttagcttcttacgccactttctgccaggggtaggcgtttgtctccgtggtgaggcatgcagttacgatatgagtccagacgaagatttcatcatcgataccttgccagaagatgaaagagtcatggtagttagtggtttgagtggacatggttttaaattcgccacagcactgggtgaagtggccgctctatttgcacaagacaagccatcacctattgatatctcagctttttctttagctcgcttccgataattagggcgttaaaccgcaataaattgtgcatctcaaatagaggtcgatgacgataaatattttaaatcagttatcgactttttatgcataatttcacccttatttcagtacaaaacatcattcaaatcgccacgggtagtatcttatactcggaaaatccgtaaaaaccactcgcgattcccgaattgacgttcaagcctttaggggattaccttatccttgtttgcgactaaatatagttgctgtcagacaaggatgtaaatcatatgaaaatattaatcatcgacgaatgcttttatactcgttctggagtcaatacctatttgaatagtgtctcatctataaaattaatggatgtccctaccgttgaagaggcaactttagctattcaagaatttcagccggatataattattgttaatttaactcaatattgtcgctatggtggtcattgtccattgttagcgcaatttattcattactgtacccgagctaaagtttatatctatttagatgcttcttacccttttagtgaaacgcctattcctctgacagaatccgtatcaatactggctaagaaacatctacccaatttactccgcaggttacctggtttctctcttgagaggctaggcattcagccaaaccaacaggcttccctgttcagcccacaagagcacaaagtgatgtgttactggatgacagagatgcctaactatcgcattgccagaaagctaaatatcagcggcagtacggtttactcacataaacgtcatatcaccgagaaaataaaagtcaggaatagattggaattgtgtttcatttataatgtgtttaagtatttgtactagttattactgataaatcataaattatcgacacaatacattccattctaattattaacttgttaatcagttagtgaataatatatcatcacttatatcaaccacactcaatcaacatggtttgttgactttttttgttacataatgaattgtgttgttaaataagaattgtattctctggttgaacgcgaaaataaatagaattgtttatttcttacctgctttcttgcctgagtagtgacctaaatatgtgttcttaagcgcatgaatttaaccgctttagctcattgtttataaaatataaagtccctatactgagcgctgattttagccacaggcagtaagcatgttcgataaattactctcaatggttatcaataatgtaagagagcatctgctgctctacatctgcttatcgcttgttttgctagggctggacatctatttctttttttattagcgcactgccgaatcatcattcttcttaatcacggctcccttaccccattttcggttcctcagggccgtaggccaattaaccagtggccctgagggttttctaaccaccgtgatatcagagcgcttgctcttcttcaaccttagcgggtttaccatcactcaataaaacggcaaatctataacccgcaggggttagctcaaggacaattttagcaataatagttaaaggcaccgagagcaacataccgactgggcccaatagccagccccagaaaattaatgataagaagacgaccaacgtcgataaacccagcccacggcccatcatacgcgggtcgataatattgccccctatcaagttaatcaaaatataaccgccggttaccgcaaaagcatcagcaaaaccgttaaataacagtgcctgaatgatgggtgggatagcagccagcaccgacccaatgttgggaatataattcagtacaaacgccaataacccccaaaggaaggcgaatctaacgcccatagctgccaagaacagccaaatgacaatccccgtggcaatgctaataatcgttttgatcaccagataatgggtgacaccatttagtgctcgtttgaggatagcattccctttttcgggattatcaaacatcaattgcactttatacggcatccgttctacttcaaacaacatgaagaccacggtcatcagtaataagaacgtgctggtcatggcaccagacaggtggctgagtagacgggtgacaaagttcatcgccatgctcggatcgacatacttcatgatgtcatctactgagaattcaatattaaaatgcagggcaaattcttgcagatcgcgcattttctccagcatcatgccgcgatattgcggtaatgagcgtgcgaactcattgagtgaagagcctaagcggccaaacagcagcaccatcagtaaaataataatggttacgagtaaaataaccgccagtgtccgtgggatttttatcctctcaagcaatttgactaagggattcagcacgatcgcgagaaaaatagccaacaggaaggggacgacaattggtgatgccgctttaataccggccatgatgaccaccagcattgccagcatcgccactaatcgtagcccttggttactcaccacaggtgttgtcattatcaatccttgtattcgaaccgccactgctcaagacggaaaaaagagacgccagcggataaagtaaccgacaacgtcaactaaagcctaattttaagtcaactaacgtctaattttaatagtataaccagcgggttaagcggagtggctacttttcatccgcactcttttctggcgagggaatgtgcatggtggcttgcaacaaccctttagacttattaaaaatcttaatgccattttcacgccctgcccgccgggagcgttgctcttcctgtggcagtttcagctcttcctggcaaatctggctacaacacccttcaaacttcgccgcgcacactggacactggataaacagtaagtggcacccatcgtttttacagttggtatgcgcgtcacaaggcgttccacattgatggcagtgcgctatgacatcatcagaaatccgttcccccatccgttcatcgaacacaaaatttttgccgatgaatttcagtggtagcccctgctcttttgctttacgtgcatattcaataatgccgccttcaacgtgataaacatttttgaagccattgtgcagcatataagcactggctttctcgcaacggatccccccggtgcaatacatgacaatattcttctctttatcatgttgcagcatatcaaccgccatcggcagttgttcacggaatgtatccgaagggacttctattgcgttttcaaaatggcccacttcgtattcatagtggttgcgcatatcaacaaacaacgtatctggatcatcaatcatctgattgacctgatcggctttcagatagtgcccgatattggcaggatcaaagctgtcatcatcaatgccatcagccacaatgcgctcacgaactttcaggcgcaaaacccaaaatgatttaccgtcatcttcgtgcgcaacattcaaccgcacttgatccagcgcagggtgtgaggcaaacagcgcgattttaaattcatcatatcgattcgcggggacgctgatctgtgcattgataccctcttttgccacatagacgcggccaaaaacaccgagcttaacaaattggctatagaggttatcacggaaggttttagcatcttccagagtgaagtatttataaaaagaaactgtggtgcgcggttcggtttcagccaacatacgcgctttgagttcctcattagaaattcggttatgtaacactggcatggtgtacgtcctgtctttcgaagaggttactgataaaaattggttactgttcaataggtaacatcaaaaaccagccagtatctccgataaatgattgcccaaaagaacgggtattttgacaggcatgaccccgtgcggcccatataatacccgaaacaccgccatgacacatcctaagccccctttttcagtcggctaagctgatgccccgatgttgttgttttacgccattgttggcgctgatgcgtgaggaggatgtttggttaatgtgaatgtatttagttagtgtaaatgtgatgacttaccttgtggccccatttatgggcaacgacatgatacgtaaatcatcatcggcctgttacttgcaacgataatcgtgatcagtaaaaccagaggtaatgaggccggccaacaaagcgatccccgcaactatcagcaaagacgccatctgccaataggctcccccgtaacccaaaatgccacccgttgccaataaacctgcactgagttttgctgcctgcattgtccagcctctgataaatattaatgatgataatttatacatcggaaagtgccgatacccaaacaataaatcccttgtagtaagtaaggtgttcaggctgctaacaaacctcagtggctcgatctgaaacagagagacaacgtaaacaggatgatcaaccgcactgctacggcacacggatatcaatatccagctcaatctatccctgccacccgccttgttagatagggtattgtgcaaccgctttgctaaccgtttgcaagcacgcgccgatcaaacaggctgatttacctcaagcggacatcctattactggatattcgtatgacgctaatggatggcacgcaggtctatacgtagatacgtgaacagcacagtacgctgtgccgtgatttttctcaccggccacggtgatgtgacaccggcagttgaacagagaaagtgagccacagtagacttcttatcaaaaccgctggctaccgcaccactcacggcggcattacaacaaggaggaatgcgccaaatagtctactgaccaagaccaaatacagcaaccttatgcctctccctcccccctcaggagcagataattatactgtgggtgataaaggctcattaaccgtgatattgctgctaaaaccgctgttcccgtgaaaaccgtggggtccatcgggacaaatttatggcgaaaatggcggtcagtagcctggcagaatgggcctgtttacttaacccgcggaaacaacaggcgtgaatatgtttattgagcgaacaaagctatgattaatataccggcgctatttttaagaaaaaatggggattcactcatgagccacagacttctcgtcaaaaaaatattttgatcaataaaccccttcatcaatacggaaacgattagcagtattaattaatcacaatgacgctgagaactgataatgcaagctcctccttttgatcgttcactgctgcacccacgttattggctgacctggatcggcctcggtattctttacctgctggtgctgctcccctacctggttatctatgcgatgggaacatcactgggtcgtttttctatgcgctttcttaaacgacgtaagcggatcacacggcgtaatttggagctgtgttttccccatatgtcaccagaggaacgtgaggcgctgctggtcaagaactttgaatccgtggggatggggctatttgaaaccggtatggcgtggttttggccaaattggcgtattgagcgttggagccgtgtcagtggtctggaacatattcaacaggcccgcgatgaaggtaaaggtgttttgctgatcgggttacattttctcacgctagaactgggcgcacgtatctttggtatctacaatccaggcatcggcgtttatcgcccccatgataataaagcaatggactggatgcagacatggggacggatgcgttcgaataaggccatgttggaccgcaaagatctgaaagggatgatccgtagcctaaaacaaggtgacattatctggtacgcgccagatcatgattatggcccgcgtagcagtgtctttgtccctctgtttgccgtcgatcaagccgcgaccaccactggcacttatttgctggtccggatgggtaaacccgccgttattccctttaccccacgccgtttacctgacgccaagggataccaactgattttgcaacccgcagtcgaaaacttcccgttagataatgaggtcgaagctgcggcttttatgaacaaagtcatagagaaagagattgccctcgctactgaccaatatatgtggctgcaccgtcgctttaagacccggccagaaggggaaccttctttatatgagtaaagatattaataccttactcctcggtgttgccacgctcatgatccgtcacgttttactgatgtgtcacgtttagggaaattgggtgacagaatcggcccgaaaatattctgatcatcctattaacactgtcaatattgatcccatggtgtttgttcaaactccgctgcaactgggtgttctgtgttctgtgttctgagtgtttgcccgtttttttattgcgtaaaattccgagttatttccttatataatcccccttggcccacactctgtgagtgattaatttatcggcaaaagacggtttctctacgcttcccaacagaaagtttcttacagcaatgaaactcatactcataagattatcgcttaatatgataatttattgataaaaaacaacaaaaataaattagcagacaaaaattccgatgtattttttgtctcaagaaacgcgccaacactaagatataaagataaaaaatgcgatgaatatcgactttttatctcaaaataagatataacccggttgggcatcaaaaatggcgttaatatttgcgccaaactctatagcatcgagtgttaaatcgactatacctaaagttgttggtattaacgcaatgccggaaccaataaagagtaaacaataaacactcagtggtggtttattcgcctaatattacggtgattctatgggaagactttatgcaaacttctgttaacactcaaggcggccgcacattttttggccacccttacccgctcagcggtctatttctttccgaaatgtgggagcgtttctcgttctacggtatccgtccgttattaattctatttatggcggcagcggtacttgatggtggtatgggcctcccccgcgagcaagcctcggctattgtcgggatcttcgcgggtagtttgtatttagccgcattacccggtggctggttggccgataactggctagggcagcaacgggctgtctggtatggttctattctggttgcgctgggccatctgtcgattgcgttatcagcttggttcggcaatgacctgttctttattggcctggcgtttatcgtcctgggtactggcctgtttaagacctgtatctccgtcatggttgggaccttgtataagccggacgatacacgccgcgacggtggtttttcactgttctacatgggcatcaatatggggtcgtttatcgcaccgctgctttctggctggttgctaaagacccatggctggcactggggttttggtatcggcggaattggtatgctcgtagcattggtgatcttccgttatttcgctgtcccggccatgaaacgctatgatgccgaagtggggttagattcaagctggaataggcctaccgtgcaacgtcagggcgttggcaagtgggtgagtgccattatgctgttgctcgtgattataacggcgctgatttcacaagggatcatcccagttaaccctgtgctgattgccagcgtgttggcctatattattgcggcctctgtaaccctgtattttgtctatctatttgcctttgccaacatgaaccgcaaagaccgagctcgcttgctggtttgctttattctgttggtatcagccgccttcttctggtctgcttttgagcaaaaacccacctcttttaacctgtttgccaatgactataccgaccgtatggtaatgggttttgagatcccgaccgtctggttccagtcaattaacgccctgtttattatcttgctggctccggtctttagctgggcctggcctgcattggcgaaaaagaaaattcagccaagcagtatcaccaaatttgttattggtatcttatgcgcggccgccggttttggtgtgatgatgctggcagcacagcatgtacttagcagtggtggtagcgttggtgtttcgccactctggttggtaatgagtatcctgctgctgacattaggggaactgtgccttagccctatcgggctggcaaccataacattattggcaccggatagaatgcgtggccaagtgatggggctttggttctgcgccagttcgcttggcaacctggccgcaggtttgattggtggccatgttaaggctgaccaacttgatatgctgccaaccctgtttgcccgttgctcaattgcgttggtcatttgtgctgcgatcctgatattactcatcgtgccaattcgccgcatgatgaataacacgcagggtaagcaagcggcctgatcagtgatgagcattgattgattactaacattgatcagtgattaacgttgatcagttactaacattgaccagttactaacattgaccagttactaacgttgaccagttactaacgttgaccaactattggctctaataacgttttgtaatagcacaaatacccgcgttatctgtaaaaaaccagcccttgtggctggttcagattactgacaaaacccgatgactcaataacggcaaaggctgagactattcataaggcccatgctgggcatcgattggcagcataaatgtatcaacaatcatcgataggggaacgtcaatcacagtgatgtatttccatggcccttcacgcatatcccactgtacaccgggataatattggtggccctgcccctgaccgggcaccgtgcggctaataatgctgccgcaacctgataacagtatgagagcactccccactaagatgagccgggcgatcatccgcaggcggcttaccaaactcaggatgagattcacagcattaaccctttcaaattcggacgatttaatgataaaacgggcaatacgccacgcgctcacccgtttttataacctgctcttatggtctgccgctactgattttgatactcaattgcgggaaatacccctacgttatgtgctcgctgacggtaatagccattccatctctgatacgtctccggctgctgccaaatctgctgatgcaaacgggaaatcagtaccggatcgctgagcaatatcagttgctgttctttctccagattatccggccctgcggttaatgcggctgtcactcgctgggtacgaacctgttcgataatcgccttggaatgatggcgagccgttgccatcgcactgaccaacgcgttatacgagggattcatcaccgcatgtataaagccatggctcaacgcgcgttgatggttcagtttcaggtactcctctgtggcaagcagcacccgtggcggatcatactcctctggtatcaggaacaatttttcctgcttactggccagccccaatgtccgtcggctggacaatacagacaccaccggtgacaagatcaacgaaaagacaattggcgataaccaccacaaaaagcgcagatccaaccaggcaaccccccccgcccagacgacccctagcaacaattgcgaaccatggcgaaccagcgcctcactccagggggtcgcatcgtcatcacgctgtggcgaattccactgtaccgaccatcccagaaaagcgctgacgacgaataccgtatggaacaacatacgtaccggggccagtagtaccgaaaacaacatttccaacagcatggaaaggagcagatgcgacgcaccgccataggctttcgcacctttcgcccagatcaaaacgatactgagcaacttcggtaaaaacagcaataccaaggtggtggagaacaaaccaatcgccaattctggccgccactgaggccacaccgggaataactggcgcggttgcaagaagtattgcggctccatcagtgtgtgcacggtttgcaaggcagtacacagcaccaaaaacataaaccacagcggtgccgataggtatgacatcacaccggtgaggaacacggcacggtgtaccgggtgcattccttttaccagaaacagcctgaaattcatcaaattaccgtgacaccagcggcgatcacgctttaattcgtccaacaagttaggtggcaactcttcataactgccgggcaagtcataggcaatccacaccccccaccctgcacggcgcatcagtgccgcttccacaaagtcatgtgacaagatagctccggcaaaagacccttcacccggcaacggtgctaacgcacaatgctcgataaaaggtttcacccgaatgatggcgttatggccccagtaatgtgattcacctagctgccaataatgtaaaccggcagtaaacaaaggcccatagaccctggtcgcaaactgctgaatacgggcatatagcgtgtccatccccgaggctttaggcgctgattgaataatcccggcgttaggattagcgtccatcagccgcaccaacccggtcagacattcaccgctcatgacgctatcggcatccagaatgaccatatagctgtattcgctgccccaacgacggcagaaatcatcaatattgccacttttacgcttaacccgccgccgacgacgccgatagaaaatacgcccatggccctcgacatcgcggcatagctccagccaagccttctgctctgccacacagatatcgggatcatcgctgtcactcaacacgtaaatatcaaagtgatcaagctgacccgttgccgctaccgattcataagtagcccgcagaccggcgaatacccgctccacgtcctcattacaaatcggcataatcaacgccgtccggtgggcggggttcaacgcttcatcaccttttatactggccgaaatactgtatttatctttgcccgtcagtaattgcaggaaccccatcagcgcggtccaaaaaccggcagaaacccagcagaacaggaccgcaaacaggatcaagaccccggtttgcagcagataaggcagtaattgcatcactgaaatctgccagttctgttgccagatatcgaagggatcaatcaatgcccaaccctgataaggcaaaatcgtcttcatatagcgggtcgcgatcgtggtttgcagcacgatcaatatcagcaagatgtagcggcgcaaggagccgacgctgcgccattttttctcggcgacggcctgttcatgggtttctgccggtaaaaccggggtttgaccgcgtaacctatcccaaaaacgcccaaccggattcgtacgccaagcctgcggtgccatgctggtacgcttgattggcggcacggcatggatcacggtacgcccttcactgtcctgccccagcacattctcaccctttagtacttccggccatgctgcctgtaaacgagccttgaccgataccaacgcgcagtcttcttctgcggggtcgcctgccacaccgctgtgtgcttggtgtcctgtgcatgctaatcgttgatgcaaacgacgcatggcatccggtgaactatcgagtaacatattgtcaggaaaagcagctcgtaacgcctcttgttgctgcgcagtcagaggcaagtccgcaatgtaatcctgaataggcgtttgagttagcttattcattggcaggtaactggtagctccaggtttcagtcagggttttatcaccgttagccagcgcggcgcgcatctctatcggtttcttcgcatccttaactttcagccgcagtgtcaaacgccaccccttggtcaccgggttatagcgcaccgtattttcgagcaactcaccgttgtcatccacgctaacctgagaagccaacggcgtgttttcatccaatgatgtcagtgctggcccaacaaaatcgaccaagaaagcaatactgccatcaggctcacgaactaaattcgactgtttcacctcccccgttgagcgcaatgtctgtttcacataggccacatccggggagtgtaacttctcttcatcacgggtaaagtgcaggcgataattaagatcgagtgactccttcgcatttggcaacacatccggtgtccagaaagccacgatattatcgtttgtctcatcagccgttgggatctccaccaattccactttgcctttcccccactcgccccgaggttcaacccacgcgcttgggcgcaggtcatagcgatcatccaaatcctcatattgagagaattcacgcccacgttgtaataagccgaaaccttttggattttcaacggtatagacactgaccgataaatgtttagggttattcagtggccgccagatccattcaccattaccggcatgaatagaaaggccattggaatcatgtaatgctggacggtaattcacgaccgtagacggttgatgggggccgaacaaaaacatactggttaacggcgcaatccccagtttatccactttgtcacgcaggaagactttagcctgaacatcaatggtcgtatcacgccctggatagatgataaaacgataagcaccggtggcacggggggagtccagcaatgcatagatcaccaaatgcttgtcattcggtttgggctgctcaatccaaaactcgcgaaagcgcgggaattcctcaccagaaggtaatgcggtatcaatagccagcccgcgagcagaaagaccataaacctgacctttaccaatcacacgaaaatagctggcaccgagcatactgacgatttcgtcttttttatcagccttattaatagggtaaagcactttgaaacccgcgaagcctaacgtctttgtggattccgaatcatgtttgaccgagccgaaatcgaaatagtccgggctataactgatgggcttaacccgagtcgcagtcacttcattgatctgtactggcgtatcgaaatacatgccctgatgataaaactctagcttaaagggcgtatccagcttaccccaatacgacttatcgtggttaaactggatttgttgataatcagtaaacttcatatcgcgaaattgcgctggaaggttactcttcggtgcttcgaagcttttacccgccagtgcctgcgcctgcttggcaacatcatctaacgaaaaagcctgtgcctgagaggtggagaataacagcaagagcgtagcacccaaccatctggcgcagttcacccgtgattcttttgatattctatgaacgtttgacaaaatattaactcgcacatcttccccctattcgggtgcttaaatcataacagccacattattgatgacttattcagcaggccagcaacagttcatcgaggtttcaattaaatccagattgatgtcgccagtacttttcttaaatctatggctaaggcataagcctagcaagtcagactaaaatacgccatgggaaattattaacccttagcgcggggctgtttcattgaatggcgtataacgtcaaaaatgacaagtaattataaagataagatagtcaaaaagtagacaaattatttccatgacgacaaaaaatagtgaataaatatgaataaaaatacgccatgcgagagtatatcctagatgctattcgtgcctattggatgttgccaggtattccttttcatctttctcttatttactccagtcactcttgggcgataaagagccatcacccgtcgcgagtctttacatgactaaatgattttattcatgcttttcgcatgcaggtattctttgttatttccggttatttttcattcatgctatattagcacaatgaccgccgttactggcttaaggtacgttttggccgagctgtcactcccctactgaacgccattccactcattaccttgccacagttatttttactcaagaattacacccagaaattacacgattggcatttatttacaatttatcaaaagataaaaattgctatttggggagtaatttctcatttgtggttcctgttaatgctcaagttactggctggtatttgtttttactggctcaagaaaatcaagggtaatatccccgcagcatcgttctttgtaaataaaattaataacataggaaaagtctcactattattgttgttataggcattaggctattccatgaaacgaaaaatattatttactcttaacccgggcgactcttcaatagcgtttttaatttatttttaatggaaatattattttatttacctttctttattctcggtgcttaccgttttttttatcctcaacttgttcatctatctggtatatcatcatcctctgcccttagtttatagcgtatttattaggccacagactgacaataatggactgggtttcctaccaggaatggcgttcgtttgtctggtcgctttcttgctgtatgaaatccattgccgcgttccttggctaagattcttgttttccggaaagcggccgcgaaaggtttcccaatagaattattctttttattaataatgttatcgctaacgaatgtaaatatctgcataccgtttatgttacgaagcggctacactgttcaaccatcatgctgatggctgaatggctaatacctcactgtgtgccctgttttcaggacaactatcctgttaagttttatcaggatttgtttcattttcagtgacaacaaagaggaattgtgatgaaaaaacaagaagatatcgaaaatggccttgcgtctgattctaacgcaagcaccgagtttcctacgctgtttgccttggtaagccgccttagcggcgcactagacggcgcgatcaccggaaaagatcgcagcgtcttggttaatgaactctctcagttttccgtcgataaccttcctgaacaggaaagaatgctgacggcagaaatcttgagacgaacgctggcaaccctcaaacgcgactagcgttatccccaacgctcacccttgattcccctctgggcaatgaaaggtgagcgctctgccctccccctactgccagcactgttctcgcctatttccccgcaacattattggtgttttagcaagattggtgtttcagcaaggcggcatgtgaacaaatcccgttgttctaatccactcagcgatttgaataagaacctggttactgcgctaaggaagataaagataacgatttagcaccttgaattaggttatatcgtctcatcgaaactcataattctgtgtataataacttgattgtaacattcgcctacccccacttaattgcatcaggagaacgcccattttggacgccatcacgattaatagcctttttttggtcggcgcagtgctggtggcagccagtattttactcagttcattttcatctcggttagggatccctatcctggttatcttcctcgctatcggaatgttagccggtaccgacgggttgggcggaatcgcgtttgataactatccggccgcttatttggtcagtaacctcgcattagccgtgatcctgttagatggtggtatgcggacgcgggcctcatcctttcgtgttgcgctatggccagcactttccctggcgacattcggggtcatcattaccgccgggctgaccggtctggtggccgcctggctattcaacttagatattattcagggcttattaataggcgcaattattggttcaacggatgccgctgccgtattctctttattaggtggaaaaggcctcaacgaacgtgtcagcgctaccctagagattgagtcaggcagtaatgatccaatggcggtctttttgaccgtcacgctgatcgcgatgattgccgcgggtgaaacgagcctaagctggatgttcttggtgcatttgatccaacagtttggattgggcatcataattggtctgctcggcggtgggttactgctgttgttaatcaacagaatggaattggccaacggcttataccctttgctggccgtcagtggtgggattctagtgtttgctcttgcgaccgcactgaacggcagcggcattcttgctgtctatctctgtggattgttactgggtaaccgccctattcgtaaccgtgccgggatattacaaactttcgatggacttgcctggctcagccagattggcatgttcctggtcttagggttgctgcttaacccaagcgacctgttacccatcgccattccagcgctgcttttatcactatggatgattttgttcgcccggccactctctgtctttattggtctactcccatttcgtagcttcaatctacgcgagcgtgtctttatctcgtgggttggcttacgcggtgcggtcccggttattctggcggtgttcccaatgatggcgggcttgcccaatgccaacctcttcttcaatgtggccttcttcgtcgtgctggtatcactacttttacagggtaccaccctgtcatttgctgcccgcaaagcaaaattagtggtgccgcctacgctggccccggtttcccgcattggcctcgatattgatatgaacaatcaatgggaacagtttatttatcagcttagttgcgataaatggtgtattggtgccacgttgcgcgatttaaaaatgccacaaggaacacgtatcgccgccctgttccgtggcaaagatttattgcaccccaccggtagcacccgcctaaaagaaggcgatatcttgtgtgttatcggtcaggagcatgacttaccggcgctaggtaaactgttcagccaatcacccaacatccaattggatgaacgtttcttcggtgattttattcttgatgcggatgctaaactccaagatatttcacagatttatggtcttaatctggagcctaccgttgataaacaacaaactttgggtcaatttgttttatacctctttggcggggaacccgttattggtgaccaaattgagtgggacggtctgacctggacgattgccgaaatggaatcagatcgtgtcagccgggttggcgttaagatcgttaccgataaggcgtaatctctttattcactgacgcgatttcacggtcagtgaattagttttaaactgcggtatgccttaattcgctttattatttaattccgttttgtcacttaatccgaatgagagagctgctcgagcagttctctctacgtcgatttaattttattcaccaacacaatcccgacgcagaccaagaccaacgcgatggcattcttccactccaaaatactctcatgcaagaagatagcagaaagaaccgcaccagataccgggattaaaaagttgaacggtgccaccatgccgacacgattatatttaagtaataagctccaaagagcgaaagcgaccgatgacagcagcaccagatatcccagtagcaacaaagcttgccagccaaaatcactgagatgcccaccaaatagatagcccccaagggttaacaccaccccaccaatcgctaactgatagccggtcatcaccgtggtatccatcgtctgcgaaatgcgcttaccgtaaatactggccgcggagagaataaatgcggctaatactaccgagccctctccgagcagcgaaaaattgaagtccattaaatctgaacccacgttgaccaccatcacccccacaaaacccagagcgcagccaataattttattcaacgttaaccggtcatttttatagaggtaatgtgctagcaggacactgaagaatgtccccgtcgcattcatgattgaacctttcactccagtggtgtaagccaaaccgatataaaaaaacacatactgcaacgccgtttgggttaatcccaaaatagcaatttgctgatattgtccctttttaagacgccctattgccttaccactggcgagcgcaaaaagcagcaatactaatccggctaataaaaaacgatatccagcaaacaccatcttactgggaatatcatcaggcgaaatattaaacaattgatagccattttttattgccggataggcactcccccaaagtagacaacagaaggttgcaccgaagaagacaaactttttactcgtaaaaagaggaggactgcggtccacatgaacatcctttacaatcaaaaaatgaaatgatgtttcgttatagctacttcttactgaaaagtcctgtttgatgtcactttttgcttaaaaagccgcttacttgacgctttatcgcctaaataccactcacacaagcaaaatgtgaaaataaaaaagacgcatgtctatttttattcttttataccctgaataattcgaattgcaggaaggcggcaagcgagagagccccgatgagcttactgtagtaagtcattcggatgaatataggccacgagaatcatataaatagaaagttaaaaagaggcgataactccgcatcatgcttatcgctatattcatctcatcacataaaacaccttcaacgtttgtactaacactctaaaatcatgtatgatattggtttaattaaataaatttggtttttattatgttaaaagtatttaacgtaaactttgacagaatgtcagagaataaattagatgagatctttacacttagaaaaataacatttaaagatcgtttggactggaaagtaacctgtattgatggcaaggaaagtgatcaatatgatgatgagaatacaaattatttattaggcactatagacgatactctcgtttgcagtgttcgttttgttgaaatgcagtatccaaccatgattacggggccttttgctccttacttccgtgatctggatttacctattgatggatttattgagtcgagccgcttttttgtcgaaaaagcgttagctcgggataaattaggtaataatggttctctcagtgcaatactttttctctctatggtcaattacgccagaaaccgtggatacaaaggtatattgactgttgttagcagaggtatgtatacaatactgaaacgctctgggtggggtattactgttattaatcaaggtgaatcggagaaaaatgaagttatctatcttttacacttgagcattgacagtaatagccaacagcagttgatcaggaaaatacaacgagtgcacaatattgatactcatacacttgcaagctggccgcttgttgtgcccagtatgactaaataggtttgatcaattgtaactcaatgccaagtcttattgcatgtttggcattgagaacacctaacttcctaacaatattaccaatatgaaatttcactgtgcttttcttaatacctaaaattatcgcaatttcagagtaagtctttcctacactggcccagtacagaatttcattttcccgaggagagaaaatttctcttttattctcttttttattcaacgtgttgttttcatgatgacttttattatatagaccaagcattttatcgtgaataaaaataagtaacatttgtattttttctttgttcacctcgatgctttcatcgaaaaaaatactatcatcatcgccacttgaaacattcaaggtcgccatattattgttattatcatgaagaacgaaggtataaccattaacaatattatattctctggcgagattgaacacggccgaatcagttgattttatattgatgactgaattgtcatcccatgcaaatggcgcgactttgcctttggcggtcaaaatcacagggtcgatcaggtgataactattcttcttgtacttttttacccagtctagtgggtagttcgatatgatcgccggatgtagcggtacttttttattcattagcaaataagaatagcggatattgccataggcttttatcctccgttggatataattttttatatcttcattaatgctttcattatcaaaaaaattaattatcatagcagaccaaatttactttatcactgcatcacattcaaattattgacattcttgaaaaaagaaacctagactaaaggatagtactaagaactagacttaaatagagctactattatagacctatgttaactaaaatatttctgctttaaagaataagtgcttaatataatagaactaatattttagcttattgttgctgaaaaagttagtctgctgtgaatatattttagccaacaccagggggcttttccgtcccaaaacggctctatgaactccgccatctgggtgcatttacatccagatggttgtgatgcttacccctgcttctcttctcagcgctcacatttggtgccttgtcttactgaaccgcaggagccacattccggccaatatcttaattcaatcgccattgggctgctaaagcacagccggtagaggtttggcttccccttttgagtagcgcttggcaatatcacgcttcaactcccgctgtaaccactcctgaaaaataaccacccttggcgaatggcctttatcctgtgggatctctagccagtagccatgagtgctggtcaccgtcagcggcaaaacctgtctcaataacccattatccagttcatggctaatcatcagaatatctaacactgcgtaaccggcaccagtagtgcaggcactgatcacctggtcttgagtactgaactcaagcgcgttatgccctgcggctacggttatctgtgccgcatccagccattgctgccagtttgtcagacgactatcaccattaagaatatgcaactgtggtaaagcggtcagtgggggaaaacgcccctgttgcatcaccagagggctggcgactaaacagagctgttcgtagcagagcaggtgcccattcgacaggtcccgacgaatatcaccaaagcggatcgcgctgtcaaaatcacaatacttctgacgaatctcactgatcagggcaatttgtagctgactattacgttgcagtaacgtaaccaaccggggggccaaccagcgggtggcaaatgtcggcgcgacctgtaagcgcagatgttgcagtggattacttaactggacatgtttcaccccctcctccagtaaatccaacgactgtctgacgataggtaacatagtcatcgcatcttgggtcaactctaaccctctgtgtccgcgtataaatagcgatttccccagaaaattttccagttgcttaatctgacgactggcggcgctttgcgtcataaataacgcctccgctgctttactgaaactcagcgtgtggcaggcctcttcaaacacacgcaacatacggagtgatgggagttttctcataggaataccgtctccataccaacgatgaaatattgcctggcgcaaaaaccacaacccagaaaatcgttaattttatgttgccaatatgcgcattttacatgtgggcaggcccgtttatttataagaattcagaggcgggtcacgtacctttttctcagaggggtatgcgtaaaacgcactggcggctttatattttggctggcacattgccatgacaaacaaaattaacctcacaggacccggtgatgaaaatagatcatccattgccgctgtccgcttctgaaataacctatctgtctctgttaggaggtcacctataaccatttttctgtctctttatcgatacctagctacttccataatagaaaaatagttagcaaatagcagacaagtgcttgttcctgttggtgacacagtcagtggcgaatacaaaatgagggaacgtaaatgcaaacattaccatcggaaaaaatcaggatggacgatgtccccctaaatcgcttccatataagaattgccgggctaacttttggcgcacactttatcgatggctatatcttaggtctgattggctttgcattaattaaactcaaacccataatggcacttacaccattatgggagggattactcggatcagccgcgctgatcgggctatttctaggcagcctaatattaggctggatctcagattacattggccgccagaaaatttttagtttcagttttgtcatcattaccttagcctcagcactgcaattttttgccagtacaccagaacagttatttattttgcgggtcatcgttggtattggtatcggtggcgattactcggtgggacatactttattagctgaattttcaccacgaaaacatcgcggggtcttattgggcgcattcagtgtcatttggacctttggctatgttagtgccagtttcgttggacattatctgagtatggtcagccccgaggcttggcgttggttgttatcttctgccgccctgcccgctttacttattctcctggtacggattggtacgccggagtcaccgcgctggctaatgggaaaaggtcgtgaggacgatgccatggccattgtgcataagtactttggcccgaacgtaacgttgattgatgaggaacccgcgacttccacccgccgttttctgtctttatttggccgtaaatactggcgacgtaccgcttttaatagcttattttttgtttgtctggtgatcccctacttcgcgatctatacctttttaccctcgattcttaacgtgatggcgttgagccagaattttgctaccgacttgttattgaacggcttgctcgtggtgggtgctttagtcggtattgtcctgactgcattctgctcgcgccgtagcttcctgatctcttcctttattttcctggctacctgcctactcttgctgagcatactgccttccaatcaaacattttggctgattgcactcttcgcggcttttactcttgtgatgtctgccgtcagtaacctagtcggtgtgttcccggccgagagtttcccgaccgaagtacgctcaatgggggtgggatttgcgacttccatgagtcgcttgggatcagctattggtaccagcctgctgccattagccattgtcaattatggaatgcccgtaaccaccaccctcttggcattcgttttaattattggagccattgtttctatcgcttgggcaccggaaacgaaaggactcaccctcgttgatgcctcacaatcagcaaccacaccacgcccaccgtccagcattattccaaactgaatgtccgtagcgctatggtcgatacaaacgatacaggaggaacagcatgcaaatgtatattggcgaaggttttgcaggtaacggggtgaatgccgcccatatcaatattatgatcggcccgcgcgatggtgttgtcggtcaggctttcgcggccagccttgcctctcccagtcaggggcattgcccttttatcgtcgttatcaagccgaatgtagccgccaagccgatgaccctgtatgtcaacaaagccgagatccgcagtgaacttcatggccgtgcaacttggggagcctcccaggctgcagttgccaaagccgtcgccgaagcgttattggcgaatctttttcccccagaggcagaggacgactggtgcatcattaccgctaattgggtgaatattgattgtgacgatattgatgaggtttataggaataactatcgtgcctgtactaccgcccttcatgcagccatggcaaaaacaccaaaacgtgatcaactaacacatgcattgacgcaactgagcaaccccttctttacccccaaagcctgaggattaactgatggattacattaagttgggtcattgcggtctgcaagtttcacggctttgccttggcaccatgaatatgggcagcaaacagtggaaaccctgggtttttgataaagcagaaagcacgccactgatcaaacacgctctagattgtgggataaattttatcgatttggctgacttctattccgctggagtaggtgaagaagtggttgggcgcatcgtgaaaaatttgatgtcgcgtgatgagttggtgctaacgactaaagtaggttacccaataggtcatggcccgaataatcagggacattcccgtaagcatataatggccagtattgatgccagcctgaaacggttgggtaccgattatatcgatatctatatgctgcactacttcgatatcaatactccagttgaagaaacctggtcggcaatgaacgacattattcattccggtaaagcccgttataccggcgtttccaccatgtttacctggcaactgagtaaaattttatggtgctgcgaacgtaatggttttgccaaaccgatcaatatgcaattacagcttaactgcgcctaccgagaagaagagcgggagatgatcccacaatgtcgcgatcaaggcttggggatttccgcatttagcccactggcgcgcggcttactcagttgcgatttcagttcagtacgcaataagacagattttttcactcaggagatgtatgccgatgtcacctcactgaatattgcgcaatctgtcgaacgggttgcaaaaaatcgtggcattactcccgctcaggttgctcaagcctgggtgcttaatcacccaggaatcgactgcatgttagtgggggccgatactatcgaacagatcaacagtgctgttaccgctctgagaatttcactcaacgccgaagaaaattttgaattggagcgtaactacaccccgtgcgatgttattaatgattacaccgcaggccagcggatcgcgcgggaagctcgcccgccaagcggtatttttgccccataaaatagctgatatacgtgattctttaactattggccagtgcaacataaaatcaatacgttaacactggccaaaaagaatcaaaaccaagggatcgtggcgttaacgcttaggccataagcgctgaactcaccggtagtggctgacgcctgcaaagtaccttgctcaataaacaatagaaaatactgttcactggaacggctttttaaacgcagaaaaggcaaatcacagcgcttatcatggctatccggaatacgtaacctagcttgctcctcagttaaccaccctttgctaaccgagcggcgacgtaaccgttgagcactgctttttacctgcacacgcctgatggtccggtgcttcacgtcggcaggtactggcaggatctcactgcattcacagtaatcctgtaaacctttcagccacccggcggactgcaactcaagtaaatcgccgcggctaccatggagacgtaattggctccccagtgtcttgcctgcagtgggaaaactgacgcctacccgccccggaattgtcgccaccagtgcgcggtgtaatttagcaaacaaggcttccaataacgtctgagcgctaaattcaggatcaggaagcacacgtatatcaagataatgatccatgccccctcctttattcgcctttctcaccaaagacaccaccacggatcaaggttgccatcacataatgttgctgttcgaccgccggtaccgtgccttttgtcacccagttgtccaataaggtgtagaaatccattttttgttttggctgccgataggctttaccccggctggtcaccgagccatagggttcaacggcaatcggccccaaagccaactcagtggcatctggataccaatcatcaatggtacgtaacgcattacccactttctgtgaatgcagggccgcaataccatcaatctgatataacactttgcttttcttactgttgctgtccagcaccaactcctgagacgggaacacttcctgcccgttacctaaacgaacaaaagcatcaacggtgaaaaaggcaaaaccgttgcccgctaaaccttgttctatttcttgtgccagcgcagtcagttccttgctgggttggctaaattgacgcaagctaaattcattgctatcaaattgataactcttcgtttggctggtgatacacactttaatatcttcagccccgacccggttgcgccacaagaaacggccattagccagattctcggcatagcgcgccgccagcacactaaaactctgctcactgatatagccattaataacactggccagttcagcctgatattcttgatcattacacactgatggcgtagcgaggttgcccagcacccgcagtgtaaaactcattttcagggtgtcagtatcaaacggcagtgcggccacatctacacgttgtaagtttgctttttggatctctgcatccagttttaccggatcagatgccagggcatttttcaaccggttggagatagtgccccgcaccgctttttctttaatgatgataggctgccagttgtcggtttgcccccagttcccggcatacatcatggcgtcggaattggataacttacgttcaaatgccagtacagaagcggttttaatcgttgctttagccatttttagatcctttaaaattattcttcatcatttaatagataggtatcaaccgatgccgggagtgcacagcgacagaggtaattatcgccttcctggtgatagccccagagcaattgacgcagatccgttatgcggtgcaacccgcgccactcaccgatgccataaagggattcaacaaagcggaacggcgtatgcgggtcacgggttttatccacttcacccggcgcatacagcggtgaaatggcacgataaccagtgacaatggggaccaaataccctgctgctggcttaccaacataaccccacggtgcaggagcaccgctttccaccggcgtatcgctctgcgggggaatagcctgtattttgagcgcggagaaatcgagccaggcatccagcatttctgtctgtggattggtttgtcttagctggttaagatgctcagccaacaattcagagcgatccagtaacgcaaaacctggcagtaagtggcacaataatctgcgtgtggcgacctcggtttcaggataattaatgactttaactctgcgaatgttggtgatagtgcccccggctaaacgctgagtcaggcacaatgacgccagatgtttttccagcgcgttagcaccgtcatccccattagcaatcgtgccatcacattcaatcaccagagacaccgtcatatgcatacggccctcttcattaaaggcggcggttttggcctctttagtgagtggattccgcgttagcgagaagacataatcgcgcccggaggaataggcatgaacttgctggtggtggcagataacggcacaaccccgtagtgttaaaccgtgactggattgcaatttacgtgataacgcgtggctgtagcccagaaaatgggtgatcgcgggaaaaccataagttaaacccgcgatggcattggcgttctcaacgcgcacctgatgtaaaacaatcagtgagctcatgaccatgtctccaggctaccttgttcaaattcacgtagccgctgcttaaataagcttgaccactcccgctgttcaacatagccaaagaccagttcatcatgctgtaaccaacgatttaaccagtaaccgaagtcttggctaacctcttgtttccaatcctctttttcacgctcgagcttaaatacggggtcatccatagcacggttcgggtcaagccaaagctgctctgagcgttttaacttacaatcttcagcgtcactccagccattggtaccgtccagattttggatttcagccacatagttaaacagaatatcaatgatttcatcgctgcaggccaaacgaacagcgcggatgtccatcgtattgctcaggggtttgacacccagcaaatattgctgcatttgccacaggttattgcgggccagtacagtaaattcactgcgatcatgaaaaatagatctatattttattggcggtttctgaatatttttccaaggcggagcgccacagggcagcaaccaaacttttccaccacggacgctgtttaggtaagagatattttggggcttggtaccgccaatattttgcaccgcagttttgaggtaaatcaccctagcctctgagtgccatttccctgctttatgggcaaccttggcctctttcgattggtcactgaaacgggcttcggcaatacgttgatgcatggcctgcgccaatgatgaagagaaaagtgggcttaacaagtggtattgatctagtcccaccgggaaataaaattgcttggccagtttatgtgacgtgagctgtttatccaccagcgcctgtttgaacccttcaacccataatgccagttgttgcgggttctctgccaacgcagctaatggcgagttatctgcccggttaaggcaagccagtaatgaatcgccgttatgttcggtttgtagcagctttgcgacatccagtgcggcggcattgccgacggcatctacagccggttgacctaaggtggcactagagagataaatagcatcattttctgccgctggcaggttaaacacactgctgcctttggcatcactgtgtgtgaacttcaatgcatgggtcaccaaactgatttgcccggcacggttagccgcatcggttaaccaattgcgcacctcataacgggctatcaactcccgccgttgttgggcaatctcttgctgggccagtgcaatatcttccgcctgagttagccctgccagccttttctctgcctctttatcaaaagcctcaagctttggctgctcgcggcttttgatataagagacaataaacgccgttaatcccttctcttccataacacctcacatatatatccgccatacttcaagctgcatgtgcgcagggctgcgctcaacaacccgaatcacttacaacaataggctcatcgggattctctcgcttgttgccttcctgcaactcgaattatttagggtataatccattaaaactgtcaatcgagtgcgccaaacacccctaatagcggatgataatgccacctctcgccatcttttttggacagcaggcggacctcaccaaattgccggctaacctcgtttaattccttatttaatgactctgccagccactgataaatccgcagacaatcggtgtctatccatgcactgtttcctgctgccagtgtcagttcaacgtcctgaaacccatcactgactttccactcaatctggtcgctatcaagacgtttaaacaccggtttatccgcttcatcgtcaatccacagattatgctgttcatcagggctggattgtcggaaaggggtgcaccgttgctgctccccactccaggtcgcctgtttacgccaccataatgcggcataatacttcaacggttcagcgctaccctgcaatatcaacctcaagctaagatgttctaaatcaacaaaattatctcgaggttcgagtttggttctttcttgaatacggctgatggcattaatcactttatattgtgagggtaagagcagcttatccagatcatgggtgttcagccgacaacgggtggtctcaaaaccgggtttgcaataaacggggatcgccggatctttttgagtcagtgccttaaaattcttttgcagaatatgcatattcgccatctgcggcgcgacttgccggtgccgttgtacacgccctgccaactggataaacgagcgcatagagctgggttcggctagcgcccaatcgtagtcatggtccctgcccacttcaaccaccgaggtggcgagcaccacaaacaggtgatgctgctccggatggtgctgtagtgcatgttcaatttcggctacctgccaaagtgcattaggctgatagcgagttaacgtcacatccaaccgccgttcaatagcagaacgcaccgctagcggatgctgactatgatagacacagtaatgaatacggtaattttctggcgcggccatcgcgtataagcgctgggcaatcgccaccagcggatcaatattggccatcctgaccacacccactgaaacggttttctcagaagggtgagtttgatgatgtgcctgatgtaagcgcagcatagaatcgcgcatcaccgccgccatagcatctagcaccgagccattcttcacactggcagagctgaccggtattaactcggctctgcgcagcacctctgccgtagacagtttccccactcggcgagtgataaaatcgccatgatgttggataaaatcttttgactgctggatatcttgctgtgcaacgccatgttcatcaaaccaggcacagcaaatattaaccggcgtatccggttgcccgctggcttgttgataatcagcccgccccgcacgataagcattgaacaacgcttgtactaatgctggcggcaatgtggctgacgaaagcagaacgcgggaacctaacatgcccgcccaattcaccaagcggcatagcgcgggcaagtcattgcgatcaaaatcatccggttcatccaatactaaatcggaggttagcaaacgcagcattggggctatctgcttgccaccccgtaggctctcggtggcagggatcaggtggtcaatggtgcagaccagtactggcgcacagagcaaacgctttaatctatcgttattacttaaccaagtgctcagccgcccatcatccaaactgccgtcataactgacatactgatgctcagaaaaaaacttatccgccgactgactgccggttccacgaggttccaatttatcgttatttaattgatataattgcaagaccgattgagaaccaatcaagacggccaaatcgtccttttgtaaggttaacttctgctgcaatgcggtaccggtctgcaaggttaaggtgcgtaggcccaaagcaacagaaaagcggcatccctgtttttcatcggacaaaccatacattatccgggcatttgcaaaggttttaccgcacccgattgaggccatattgacgccgaaaaaaccttgctgcagagaacgctcgcgcagcgtgacagccagatcaaaggctttatcttgccaacgatacttttcctgaaccgaacgttgtttaaatcctttatggcgagtgattgctggtaaggttttgcggatatgtggcaagctgcggccaagcaacagcgcgttctgccccacaccaatattatgttcatccagccgctgcttcatttcaatcgttttactgtgggcattcacatccctcattttattatgggtatttgcaaatacttgatagtttttatcctgccagccgggagtggccggtaatgaagaataatgatgatcggccagcattaacgccagacgcgccatatggctggtaaaacgctggttcaagtgaccatcattaaccaatgacggttgtcgcaaagcgcgtttggcaaacttttgtgcctttttacaccattcggcactttgtagtggcgtgccatgcgggaagcgccatacatccagcttatctttttcacgccagtcaccgctgtccatattggtcgaattccataccggcataagctgctggtgcaaccaatcatctatttcctctactttagggggcctatggtaatccttggagggatacacgggtaagcgatggtgtgaaaggatcaaccacgcgatagtcttggcaagaggaggtaatgcaacgaggggattggtatagtcgtctagcccatctttaaccaaattggacattaaagcggtttcgtcagcgggattaatttggcttaaggctgtgagccattgaatatcatttttctgttcaacaaaagcttgaaataaacgtaatgaaacccactcatgccgatagggttgatatgttttcccctgcccttgcaacccttgttgaaatagtacattggccttaccaaaatcatgaaataacccagcgataccggccagcagtgcaatggtctccacactgtgccagttgttttcatcctggctgcgcaagatatcccgttgcgtagtattggttggcacggttccctcagcattgaaacgtcttaaattcccaacaatccatagcaactcgctttggttattacttttgatccaatggcaggccaccgcactattacgccgcgccgttctacgcaataatttacgtaatgtatttagcccttcctgcgttattgccgtctgccatgtccgatcacctttacgttcagcaaactgatccaaaatacggcgtgtttcatcaagcgcccgtttatggcattgggatatcagtaaaatattcatcgcggaacctggctacataacgctgccgtttcttttattccatcaatcatcacatccagcgcttcggttcgttgaaacccgctaatgcagcgctgacgaaattcttgctcttcttctccctgcatggcggcaataaatgcctgcggtagcactagcgcatctttaattaaatcggccacatcaaagaccaaaccaccacgccgggtcttaccgtgtaaaacagacagaccatggggtaagccaataacccatgtcgccgtcgcagctaagccataggcgagataatttccgtgatcgagaaaacgattagctagatcgatgcccccaccgcgtttagtgcgggtgaaatcaccgtaattcactgtattagcagccagtttatagagcgcctttgttaataccgcttcctgaaccataaggtcattactggtgagacaattcgctaaattttgctcaaaacggctgaggataaataataattgatcgtgattaaccggaaaaagagattcgcgctgtatgtggctgctgagccaatgttgttgaatttgggcgatcctgatgcgctggaaagccactgctgctgccagtcttttttcatcatcgaaccagaaactgacccaatcgtgcagatactcggttggccggtattcgctttgtgcagtgagccacgagacattgacctctacgtcattagccgcaaaaagcggcgtcccacccccgccacaaaaaccgactaagaccccggctcgggcaaactcacgcatagcagcctgagtcaccgaagtcccggttcccagcataataacggtggtgttcgctatggggatattccagtaaagggattgtttaccttcatcggtgacatattcaactcgcccaccattaaccaatacgcggcaatattctaaatagtaaatattggatcgttttgaatgcaggatcgttttcaaatcagaggaatgaatagcgttttccatagccaaaaaactccttagcgggatatccaccgcgctatttttccgttagcgctttattagcagatattcttccaaaaaataactctctctatacccaaagtaattcgagttgcaggaagccagcaactgagtaaatccccaagcacttacaccagtaagtgaccgggataattgagcgcagccaacatacatgcagtttgaagtatgacgggtatatcttgatatgctacctgctatttaccctactctaatactcataaagtcagtaataaaagatgccattctccctgttgtcagttacaaaatgcgcttccgctcgcaattttgctccccaaatagcatcaacgcatggtccagaatttgattattgcctgtgcggcagtgaaccccagcgtcgggtcggatacttgccacgtaactttctaagctgcctgtgcggcagtgaactagagtgttttttctgacgatgttccttgctgtttctaagctgcctgtgcggcagtgaacccagagcctcctgatacatctgatcccacagttttctaagctgcctgtgcggcagtgaaccatcacaatgctctggatgacgcaattcatcatttctaagctgcctgtgcggcagtgaactgattttgattatcctatgccagccgaatatagtttctaagctgcctgtgcggcagtgaactaaagaccgttgaatttaaacaaggtatcaactttctaagctgcctgtgcggcagtgaactgaaagggatcgggctgaatgcgcaagacgcgtttctaagctgcctgtgcggcagtgaacagtcagggctatgagggggctgcaatgggcgcgtttctaagctgcctgtgcggcagtgaacgttttttcgaccttttcctccatcagcgaggctttctaagctgcctgtgcggcagtgaataccgttattaatgggtggcgctggcgcttcattttctaagctgcctgtgcggcagtgaacacgtggctagttattacgatacaattaatctctttctaagctgcctgtgcggcagtgaacgctgctttcttgtcaatccctgacgggttctttttctaagctgcctgtgcggcagtgaacatctccggagagttcaactgtggggtggtgtatttctaagctgcctgtgcggcagtgaacttaagcatcacacagccgatggtgtggttgattttctaagctgcctgtgcggcagtgaacccggatagcgaaacttaatgaaaatattatcgctttctaagctgcctgtgcggcagtgaacaccagttgtacatgtgtcagtttgtcgactcttttctaagctgcctgtgcggcagtgaacagtaagataatacgataacatcctgtttgtaaaatacttatttcgctaatggggaaaaaaccctttttttagaccaccgataaccacaatgtaaaatcaatgagttagcagtagctaaaaaaatagggtcagaacataactcataataaaaccacagtacaattccacaaaccatgtcataaaccacagcctataaagatgtctcccccctcgcggggcaacaatcgaacaaagatacagaaccacaatgtaaaaaagggtaaacaggtgcaccccctgcgcctatagcctttaggctaaggccttttagtcagattgatgctttataggagcagtgatgcaacaaagaataagccagtggctggaaagattggggatggagttctccaatgtgatgtcattgacgatggtgattgggctaatattattgatttctgtgatgatccatctggtgctacaccgtgtagttctggccgccctccagcgccgtgggcagcaatcgcaacgcatctggcaacaggccatcacaaaacacaaactgttccaacgcgtagcgctactgctgcaagggatcatcatcaatctccaggccgtactgtggttgcaaaacggcagccagacgcaggcagttatcgttaccgccgcgcaggtgtggattatggccttcgccctgctggctctattttctttacttgataccttgctagccctgctccgccagagttcagttgctcatcaattacccctgcgcggtatctgccaagggctgaaactggtggctgcgatatttatcggcatcatgatcgtttcgctgttgatgggccgatcacccctgttgctactcagcggcttaggggccatgacggcagtactgatgttggtgttcaaagacccaatccttggtctggtggccggtattcagctctctgctaacgatatgctaaaaattggcgattggctggagatgccaaaatatggggctgatggcgcagtgaccgatattggcctgactacagtaaaagtaagaaattgggataacaccgtcacgaccatcccaacttatgcgcttatttccgattccttcaagaactggcgctcaatgtcggaatccggtggccgacgtataaaacgcagcatcaatattgataccaccagcgtacattttctgtcagaacaggaacaacagcgcctcaccctcaacccgctgttacaacactacctcagtgaaaaatcgcaggaactgaaccaatataatcagcagatagccctcgacctcagttcaccactcaatggccgccgcctgactaacatcggaacgttgcgcgcctatctggtggcttatctgcgggcacatctggggatccatcagtcgatgacattaatggtgcgccaacttgccccaacacccgagggcttgccgctagaagtttatgcttttaccaacaccacgatatgggcagaatacgaaggtattcaggcagatatttttgaccacatctttgccgtggtgagtgagtttgatctgcgaatccaccaaacaccaagcggtaacgatatgcgcagtatgcttgccaaagtctaacgaaatcatttttactggtaattatcctcagctaattgccagtaaatgccccctacccgccactctcttggtagcaaccataattaatatgtgaggcccggatgaggatgattaaaatttagcctggcgatgctactcgacaacacgcctcacaattaacacccctgaaaattgattggctgattgctgtgagtagcgggctgattgtagcgtttattaagtggtatttcaaagtatgtaatacgtcagacatggtcaccctaatatgtgacgataagccatattttctctctctgaattacccaatattcaccgttccgctgcccatcaccacaccaccacaatcaatgagatcgccagatctggctgcagcctaaaaaaaaccagtaggcaaatgacttttctacttgagtcacgcgtgaagtagacttgctgagagataatgaagataaagatggcgataaatataaatagaatatggctggtgtactaatggtgctctgaaatataaaaataattcagagcaccggggctactatttacaggatgatgcggttatcactgtttgatattccgcttttcaagtgccgattccaacatgcgcttggcatcagggatagattcaatcaactgaagagtgagcaacgcttcaatcgtggattctgctcccgagtttttattcacggtagtggtcgaatcaataccatcaaatgcgatcccggttacggggtaatacatttgtgcctgtgccggattatttttaaagaaccacagcgataaatccaccgcgcgctccagataaacggcgtcacgcgaaatctcccaagctttgatattggcaaataccatcgggcggatgatgtaagcaatctgggaaaacttcttctgttcaatcagcgtgactttttcaccctgctgccgaacggtaaactcatttaacaacccattactgatcaaccaaggatggaaatgatccagctcgttaaaggcagctttaatcatatccctatcgcccagccggttacccgcaaccaacaaagcgtaagcctggctgttaccatagccatgccacaggttttgccagcttaaaaaagcgccattcaccggtgaagatgtatccttaacctgcatcagcatgatgccagccgccagtgaacgcatcatcttttcaatttctggttttgcttccagcgcctgtgcatcgctcagggccatcaacaatacagaagcttggtcaccagcggtatgaggcagccactctggcaccgccacgccctctttttcgccacgagtctgtttgaaattaaagtctttataaataacatcgatggtggcgaaaatagtctcgcgggttctttgcgccaacgcgttatcggttttcaccagcgtaggataaacctgagtcagcgcccataatgcacgccatgtccaccaatttggctccgccacactggttttatactctttattaatggaatgatcagggtagataaaattatagaagtaaccattatctgcccgttgatacagaataaattcgaccagcgattttactttttctaaatctgccgctgagcctgttgcctggtattgacgttgataaaaaattgccgcgcgggcgacatcatcaatggcggatacaccttcgatgggatctttaacccagcggtaatctggaaattcgctatagatatgaatcagacccagttctgttttgttcgccaccgtgaccttttgatataaggcatccagatgctcagcattaaccagcttcgcagaggaagaaaatgatgttaaaccaatgatacaaaccagggtatttagtagtttcatattatttctcttattctaagttagttatttatagccgcttaaaaaatataattaattcctaacttgccaaaatgcgtggtggtatcactgtagcttttattgtcgcgtacgccacgatcccagaattttttgtcatgctctacccggtagaaatattcggcaaccaaatagactctatcggcgataggatagctatagttaaaaatatatttttgagctttcgaggtttctctataaccatcttgcccgccgatacgtcttaattgtggttccattttaaacaggaagttatttttacccatgttccaggcaacccaagggcgaagttcctgttccaagacgtttgctgttttggtgccattatgattaaagtcctggccttctttacggaacacctcgataccggcgtgcacattatcggcgacccgataatttacattaacaagtgcttcgtagaactggaaccgcccattatctgcaccacgggcatctttatcttctaccagcatttttacatcagtattgacacttaagcgatctgatacctggtagcggtaatagggccgaaaaccataaccatcgccgccaatattgttatcgccgcctgtcgtgcggtttttttcgtagcctgttttacctaaatagatcccttcgaacataaaccagtgcttgtcgatacttttcgaccaggcagggcggatttccatttctaccatgcggaaatcaactttatgattgctctcattacgtgagtcactggtaaaccgtacttgcttgagtaaaaaaccggtattccagcccgtatcgccaaaattgacgcgcccatcagcaaagacaatttcatgcactggccgagagttagtactgcgcccctcattgcggaaatgttctattttatattctgccaaccagttgccatggaaataggctttttcatccttagggatgcgcacaatcccaatattatcatcgctgagttctacgacagcctctatcgtctcaccgccatcttttactattctgattttgtcaccggcaaaaaaagtccggttatccatgttattagcgcttaccacatccggagaattatccgcttgagcaacagaacagatacctgccatcagaaacaggggtaaatattttttatgtttcatatgcattccatgtaagtaggtggtattcccaatcgataaataatgggaactccacccaatctaattgatattaggttttttctataaatcgagttaaaaacgcaatttagattttctggtaattaaaatccgctaaaaggatcttcaatatcaatccagtgcgcttccgcatcgctggcaccaacatataatcgccagccgttgttaggtaatacaattaagccgcccggaaaaataacatccactaagtccgggcgtttagctgcaccgggtagaaaattatctctggctgcaataatttttattggcgtatagtttttggtgtccgggttaaagataaatacgcccgggtagtagtgtctccttccatgttgatcgaaacaggcaatatgggaaagtaacccaatggtgccatcgcaaagtaaatgcgtttcgttgacgccgccccattcttcggaattaaactgctgctcgaacagttcggcgctggtgatagtttctggcgttagcgcctccaggttgtttatttcaacatacccaatagtgcctctgccgcctattttaccttgtggtcgggtaaataccccgatgcgcccctgctgaatatggcacaaacggatatctttcatccccggcgggccggaggcgaaacgcgttaatgagtgaatatctcgcccacggaaaaatacggtgtgccagatgagttgccctgggttatcagggtgtggattaatttcaaccccgccaaaaataagctcatcctcaatccaggtgaaaaaaggatcctgtaattggaatgtcggtgcgttttcaactggtgcccatcgcccttgctgttcacggaaaaacacaatagtcgaatgctcggagtctctcgcttcaacacgtccggcgctcacaacctgcccggcagaggtaaatggcgcggtgatgttataaacatccttgtcaccgacccccgtgaattcgagccgaccggtggaaaaggtgttgtgagccgtccgtttttggtaatcggcgaacaattgggcaacgctggctggtggggcatgtctcatcatagaagccttatttttttatcccgtaattacaccgacaggtgctgccacagttgagccagcggcatttcagccaggcacatacattcatccgccgcaccgtaatagacccgtaggctatcgttctcaatgagtgcgccgcaggtaaagacgacgttaccaaaaaagccgtgcagctcataaggagcctgcggttgaagcaacggtaccggcgatttagcaaggattttagtaggctgttccaggtctagcagcagcgcaccgagagaatagcgttgggtcgcatctaccccatggtaaatttgcagccaccctttttctgttttcagcatttgcgccccgccccccagtttcaaggcatcccaagggtcttgcgatgtccccagtaaatgccgatgatctccccaatgcagcagatccagagagctggccagccaaatctcgggtttaccgaagtgtttaggtgccgggcggtgcaacgtcatatatttaccgttgattttttccgggaacagacacgcatcgcgattatcagggcagaaaatcagccccaaacgcttaacgtcggtgaaatcctgggtaaccgccagcgcggtgcaaatgccctttgctgacactgcggaatagttaatatagtaagcgccgtcgatctgagtaatgcgagcatcctcacaaccaaacgcttcatcaccgttggccgggaagataaagggttgatcgtcaacgacgaaagtaacgccatcatggcttcttgccacacgaagatgggagagagatgtcaggtacacggtcgatggatcggcgatatcgctgatcagccgaggatcactaaaatcgtaggcggggtcatcgtgcttaaatacccgcgtggtcacctgccagtgcccggaaatttccataagcaaaggcacgacggtaataccctcactttcagggataacgctctccgcgatacgaatcaacataatcgtctcatcgcccagtttggtaatgcccgcattaaaggcgcattcaaccttaaatcccggatggcttggcgtaatatcctggggtgtgattaacggattgccggaatacctaatcattatggtcctctatataaatagcaatatcgtggtgagtcatttcaccgcgttttcgagtatcaaatactttcgattatcaaataatttcgagtatcaaataaaagcatttcacgtcactatttcatatcagtcatcgcgtcagctccctactttaatgatagggacatgccctgcatgaaatatttacggaataaaataaacagtacgacgatcgggatggtctgaatgaccgcaccagcgatcactggcccaacataaacgccataagatttgctgaatgtggccagtaataccgagagcggcattttgctttcatcctggataacaatcagtggccataagaagttgtcccatgtgccgacaaaggtaaacaatgccacaatggcgataattgctttattcagcggcatcatcaggtaaatcataatttgccacagactagcattatcaattttggccgcatgaatataatcattcggcgtcccctggaagctctgtgaaatcataaagatcccccaagaactcatgagaaaaggaacaatcatggcgctataggtgtttaataaccccagttctctgactaaaacgaattgcgggatgataaacatcgacgcagggaaaaccatttgtaaaaacagtaaattcctaaacagggactggcctttaaattgcatttttgccagcgcaaatccaataaacatggagctaagggtaacggctaccgtcactactgttgaaataaagagtgagttaaatagcgtctttaaaaaaggtttttccacccggccactgttttcaaacaaaaaacggtaattatcgagtgagtaagcgctaccaaacagcccggtagtataaatatcggcagactgtttaaaggaagaaagcaccatccagatatagggatagagccacgaaagcgccagagaaaacataaccagatggataattaaactgttgatgttttttttcatttaaacaatctctacctttctttccagcaattttctgacacccaagataattccaaaactgatgagcgcgataaagattgacatggtcgctgcccaacttggttgcatcttcataaacgcggtttcatacatcacgatcattggcgtggtggtgctattaagcggcccgccaccggtaatgagatatggctcggtaaaaatagcgaaggagaccgtaatggctaaaaccagcaccataattaattgcgggttgatcatcggtaatgtgatatggaacaagcgcttaatggtgcgagtattatctaattccgctgctgaataaatttctttgggaatactgtttaacccagaaaagagaatcaacccgtagtacccgacaaatttccaggtaacgaccaaagcgatagataacatggcgaagtccgggctggttaaccaaggcagcgtaaatccaaaccaatcatataagaaggtattcagcggcccattctgactaaatatcttagagaacacgatggaataggccacgccagatgagacgttagccagtaaaaaacttaatgcaacaaaggtcctgccatattttaatttctgtaaaccaaacgcgaacaggaatgaagaggtaaatacaatgggcaagtaatacattaagaaacgcatcacgttcagcatcgatttccaaaacaaaggatcttgcattaccagaataaagttattcagaccattgaacgtaggaataccaacaaaacgccactcagttagcgataaaacggcgagccaaataaaaggataaaaccagaatatgctggtatatcccagataagaggccgctaatacgctgcctacctgtttatctttaagctttaaaaaagtcataatgaaaggccacctggctcactttgatgcagaaagcaagaaattaactcattcttactgctaggattccaaaatattaggactttaaaatcctagcgttttaaaatcttagggctttaaaatcgcgttcacttcttttattgactgttgcaatgcttcatcaggcgttgaggtattaaacgcggtcttctcaatcatttgtgtcatgctgcgttgaatttccaccgtttcaccactggaaaccggaggtatcgccacgttgacatattcagcgtaggccgcggcatacgggtgttcctgataatattcggcaaagaaaggattggtgagcaaatctgccctagcgggtggcataccggtcaattccatccaacgtttatcgaatttgggctggctgaatacccactggataaactcccacgcctcgggtttaacctttgaatgactaaacagcaccagtcctttaccatcggcgaaagtatgtggtttatcttgctgctctttaaccagcatcggccccatttttatgtgctttaaaatttccggatattgttgttggtagcggctaatatcccaaggaccgcgtactgcgcccaatactttaccggtgactaatggatcatcctggccaaaatcataaagggtccatttttttgaaaagagtgtgtgcataaagtccagaacgtcacgaccggcctggttatcatagctggcttgctgattggcgatataaggcttgccatcactttgggcataatagagggcaataaaatcaaaccaacggtcccaccagttacggccagaagtagcttgtatcgcataacgtttgtctggaatggtgtatttttcggagagtgcgtaaacctcgtcatacgtttttggcacctcgctaaagccctgctcttttaataaatcgccacgccaccaaaagagtaccgggttcatataaatcggcaggatgtagttttttccgttatagcgccaattatccataatatccgtcatctgacgggtactaattaagttttcatagccatccagcgtcgagagatcaacgacctgccctaagtcagcaagctgagaaccaaagccggtaaaaatattttctgagatatcaggtgcgcgatcagaagcaatcgcattcattatcgcctcttcagagctgcccgctgccgggatcgttgagaagacgactttctttttatctggttgtttattccactccccaaccacttcgctccagaatgcctcttggacattgttcggcgctatccaaagcgtgatgtcctgtttttcatttttagccgatgccgtatcattgtcacagccagtaaacaccacacaactggaggcaattgccaatgaaatcagggtattcttcattttttctaacattattctattcccagggccgttgttgaaagaaaaggctggaagaccaattttaacgttaaaataaaatagcagcgtaatttcgataatgatgtgaagtatttcacatctcatcattttatgtttaacgttaaaatcgtgacgttcgttcaaattttaacgttaaaattgagataacatgctattcctgaacggtgaggtttgatcatttcacaagacggaggggggtataatacaggcagtttgtttagttcttcttcccggagcttttaacatgaccactggtaaaaaaagagaaacgcttaaaaccatcgctgaaacgcttaacgtaacgcatacaacggtctcgaatgtgtttaatcggccggaaaaagtatcgcctgaattgcgagagaaaattttagcctatgccgaatctataaattatcacggtcctgcaggtgctggccgctttctgcggaccggaaaatgtggaacgcttggggtcatctttaatgacaacctcagttatgttttctctgatcgccatgatattgcgttgatgcgcggtattgccgaagagtgcgaaaagaatggtattaacattgcactgatgccattaaaaacgaataacgcgctaaaaaaacggatgatgggtgcactggtcgatggttatattttaaatgcgacctataacaatgacgaagtggtccaggcggcgttgaccagtggcttgccggtcattaccaccgatatcaaactccagaatttcacctgtgtttcgatagatgacggggctgctatgcaggctatttgccaccacttgttggcagccgggcataagaaattcggtattgtctctttccctgtgaaaaggctccccggcgagctaacatcactggctgaattctccactgactatgacaatggtgtggctttcgggcgaattagcgcctgtataaccgcgctgtctgacgctggaattgatttgcataccagttatgtcgcggaacaaccgcacagtgaaaccgggggcgaaaaagcggccaaagcgctgctggcaaaggaaccgggtatttcggctattatttgtttatctgaccgttttgcattcggcgtttatcaattttgtcaggaccacaatattcccgtgccaggccaaattgccattaccgggtttgacgatattgatattcaggatccgccggttggtttaacgaccattcgccaacctaccgttttaaaaggccgtgaagccgcaagggcccttatttcaggccaattagacaatgatatatctttagattttgaacttgtcgtccgtgattcagcataatcagattggaaaggaaatggaaaaattaacctgttttaaagcttacgatattcggggaaaactgggctcggagttaaacgaagagatagcctatcgaatcggacgcgcctattgccagtggctaaaaccagccaaagtcgtggtgggtggggatgcacgggcaaccagtgtcgaattaaaaaacgccctggcaaaagggttaatggatggcggtgcggatgtcattgatatcggcatggtggggactgaagaagtctatttcgccacccgcttttatggtgtcgatggcgggattcaggtgacggctagccataatccgattgactataacgggatgaagttagttaaaaaagatgcccaaccgattagcggtgataacgggctgtatgaaattcagcggctggcacaggataatcattttgcgccacctggcgtcaggggccagcttgaaacccagttggtccgcgaacactatgtcgagcacttattaagttatatcgatctgaatgcgttactgccaatgaaaattgtggttaatgctggcaacggcgcggctggccccactcttgatgcactggaagctgcgctggcaaaacgtaaggtgccaatcagttttattaaaatcaaccatcagccagatagtagttttcctaacgggatcccaaacccgatgttgccagagaatcagtggtcaactcggcaggcagtttgtgagcatcaggcagatttaggcattgcctgggatggggattttgaccgttgtttcttcttcgaccaccttgggaattttattgagggctattacattgtggggctgctggcagaaaaattcctgctcaccaataatatgggtaaagcgactcacaatactgacaaaataatccacgaccctaggttgacgtggaatacgatagatatcgtacagacacttaatggtacagcaatcgaatctaaaaccggccatgcctttattaaagatgccatgcgccaccatgatgccgtctatggcggggagatgagcgctcatcactatttccgagagttcggctattgcgacagcggtatgatcccttggctgttagtcatcgaattactgtcgaaaaaaaccacgtcgctgttttcattaattgaatcccgcaaggcgaaattcccggtatcgggcgaacttaatttcaccgttagcgatccaaaaactaaaatccagcagataaaacagttttacgctgatagtgccatccacgtaactggaattgatggccttagtatggaatttgaacactggcgttttaatttacgctcatcgaatactgaaccacttgtgcgtttaaatattgaaactcgtggtgatgtcacacttctggagcagaaaacagcgcaattaactcaactgctttatccaaagtaattaaagttgcaaataacctttcgttaaaaactaataaaatcaacctcgcgttcattattgaacgcgagggtaaatagcagcatattgttggagcttataatggctagcgtttctctcgcaaatgtcgtgaagtactatggaaaaattaaaacgattgataacgtcaatcttgaaattgcatcgcgggaatttattgtcttagttggcccttctggctgcggaaaatctacgttattaagaatgattgcagggctggaggacgttaacagcggtgaaattaaaatagaagataaagatgtcacccaaactaatgcgggggcacgcggggtatcgatggtatttcaatcctatgcgctttatccccatatgaccgtgcgagaaaacttggcgtttggtctcaaaaatatcaaaatcccgaagcaagagatcgccgacagaatagctaatgcgtcaaatatcctgcaactggataattatcttgagcgcctgccgcagcatttatccggcggccaacgccagcgcgtcgctattggtcgatctattgtcagtcgctccaaagtatttttatttgatgaacctttatctaacctggatgctgcgctgcgtattcagatgcgacaagagatcggcaaactgcatgaacgcttaggtaaaaccacaatatacgtcacccatgaccaaacggaagccatgacattggcggaccggatagtcattttaaatcaaggaagaatagaacaaatcgggaccccggaagaagtttataaccatccagccaatctttttgtcgccggatttattggtgcccctaaaataaatctatttaatgcagtttatgagcaggatggctacgttaatattaatggactccgcttttttattccgcgattggtgaatttgaatttggcaatgggcgccgtactgactttagccatccgccctgaacacttctccttaaccaacagcaccgaactgagtctggcagtgaagacagacatcaccgaaatgcacggagattccacggtggtgctatttagctcaacagagcacggcacgctacaaatgaaagtcccctatcaactgaaactgtccgttggtgaagatgttactattggcgcgtcctgcgaacatattttagtctttgatgagcacggtcaggcaatacacggcgagtcatagcaggtttaggcgtgtgtcattcctgtatatttccggaatgacactcagatcgcatcttgcaaagcatcattcaaaaacaccctatttataaaccacattcccacccgtatccggcttgccatcagtattactggcaccatttctcgccacttttatctggtgtcaccaacgctgttcccttgttttgatcgggcgcagaatttatcagcttacccccggtgggatcatcaactggattagggaatacagtcattatcaggttgattatctatcaaacgttattgataacaaggaggctttggctgaatcgctgtaggtattccagagttcttctgtgctgttaaatgcgatgataacgcctctgtccataaaggaagttattagcatgacattatgaatatctgtatctattgccttagaggtaaaattaagcagccatgccttttggcccttatctacaattacactctctgccgctggttggtagttgcgcatcgcatgtaacaacaagtctttataaccatctaattgttcaatcttaagtggtaatatgcccacgctcatagctaagtttaccgtccctcgctcattggtaaaaaccacttgagggcgattatctgaagggtatttatattttttcatcgtctcatccatacgaagaaaacctttaggaatattgagagatataccctgttcaggaatctgctggcgttccataagtatctgagcttgggcttggattgaaaagacaagaccaatcgcgacactaaatatccccttaagtgcttttttcatagatttgtagtccaagataaataggcttatttaatggcaattatgatgcaacaaagtgtctaagggaaaagaaacgattcagactgatcttccccgccatcattgtcagcataacaaaatgatcaagatcgtcttccgatatcttgtctgcgatctctttggcgacaatacccgtaatacccgctttaacaccgaactccagaacttgcttcgctatcagacttcggcagggtgcagcgataccacatcccttcagagccagacccagcgcattattctctacgatagttataatgttcaggaacttgatagtcttcagggaaaggaaattcttttgtctctctgataaaaaagtcaatatcttcaactgattgataaaaaaccccataaatagacatcataaaaaccctgatatctaaaagagccgctctcatagctaattcatccctatgactctctgcactgacaaacaaatcaatggcttgattgagtcgtatgatatttttttcgagctgacatttaatatcatcatcttcgctaaggtataattcttctccctcaggttttgtgatttttttttcaacaatcattttcaaaaaaacgttcttaaagtaatcaatgggggtcatatcaatcattttggtggttttctcccttctgcaactgctttgttggttttatcttgatttattgttccatctaaattaagtacagtgtagtctcccctgcattttttcagtcgccgcctgggtggcgataatctgcccctgtgtgcggaacacatcccccacctgactgcctatctcgccgataagctgcgcttccttcagccggttttgctctttctctttatcaaagataggggaaagggcattgttggcatgctccacatcacggctcaggtcatcaacattctgctgctggttatccgtgtcgcgcaccgtgatcgtaccttcagaaacggccgcatgggtggtgctgtcggcgtggccttcgttattggccccgaccagcaagccgttggccatattgccaacaaactgactgccgatattccccccggtgctgatacccacactttgatgttcaaccttgaaatcggcttgattatcgatatcactgaagcccagtgtcccggtatccagcgtgtttttatcggctgtcgccgtgctgccaatcaccgcaccgtcaagctgggtatgtccacccaccgtgatatcaaagccgcccgaaccggcaaagatacccgtctgctcctgcaccgagtcaaagttgctgttcagcttgtcctggctgccattgatactgatactgcccgtcatggagccagggctgaagctgccgccaacgctgctattttgctgtttggcgtcatagttatcgctgtcctgctggctttgcagcaacaggtcgcggcccacctccaccttcaccgtttcgccgctgacctgcgcaccgaccagtgaggtatcgctaggcccaatgccgatcagttaaggatcggttgaacgagatccttaactgatcggcattgctgcatagcaggggttttctatagacaataattatcctccggcatagtcgggggataattattcaaggtttaggatctgacggtggagactttcgagttttgtattcatctatcttggcaaaaatccatgctcctactcctccagatattcctgcaatagcactcagtacactcgttttaacaaaatcttgcatatctaaagttagagttcctaaatataaaaaacttatcgagaaccttattattattcctaaacaaaaaaatacagcccaaccgtataagatagctaatatcaaactttttactgtcagttctcttttcatttttttattctctaacgtattaatggcatctttagtagcactatttgttgcttcatatgtaaatgcactaccaacttccgcccacaagccttgtagtagctcaaacttaatctgaccccctgcccattaggcgcacgatattcaactccaccacgagatagttcatttcgcaccgtgcctgactcatttagaaggtcccgaataaagttttccgctgctgcatttttctaagcctgattgcccttcagaggctcgaatgttcctcctggcctactggcatgtttttcccatgctctggcagcagcagacactccttgattattgatcggtttgttcgctgatgtgatccgatcatctatctctgagttagtgaaattactcccattctgtgacggtttattatcctcattattccgagcattctcttcatcttccggcccatgaccgccaggagttccccgatccagcaccacccacatcagctttatcctcgtccgtcagatcctgctccacattcggctgacgtgcgttttcttcacgaaacttgttcggatctgagccattatccacatcctaggcttcatttctgcctgcaccattaatggacgtattcggtactgcaacaggtggcggaaccggtattggcaccgccagcaagttattctcaacaacaacttctgaagctaaaaaggataatcccggatcggtgtcgggatcttactgttattgcttaaatttaatcgattcttgatctaaataagtttgccagtttctaaataatcgctcagtattttccctatggctatgagcattaggatcatagccatcactgacaggcatatatgcaacaaaactttcaatcgcctcagggtaatcaaaatcctcataaatagtctcaaccatttttaatggttctgagtagttattacgattagtaaataaccatagcaatataataaaaagccatttttcttgagttgcagactcatcagcatctatacaacacattgataaatcatctaaaattaaacttatctcatgagtatccattttactcttaaaagacaactcaagttctagctgtgacgcctcacctaatgacaccaaatgttcagcatgttttacaatcgaatgccatccgattaatttcttttcataggcccacttaatatcaaaccatgacaatttaatgtgactacaaataaattcatatgatattgaaagcatatccatattatttcaccttcggtgctttttggtttggtattccggttatgccaacaccttcaataaagcgttggtgcgtcacatttcctgtcttatcatagatatactcaaaaactccatccttgccattaaaggttcctttagtctgcaatagtgaacgcttcacaccatccccaccagtaatattgaatacctcaccagccattaattgttctcggtttaaatagctagcaccacgatggctaggatctggcttaagaccactaccaacgcgttgagcgtcaagaattttatcaacaaccgaagactttattaatgtattcgcagttttacccaaaacagcaattgcacgttctaaaggtaaagaactcaataacgccagagcatagtctttagtcgattctgcttgaagcaacgccatcacagtatctgatgcaggggtattttccagaattgctttaactacatcttctggcaaatcacctttcaaataatgatcccgaatagcttgtttttcttgcacagtcagcgtgttatcggttgaaagctccctttctaacgaacccgccccttcaaaatatttcgcaccttggctaccaaatatatctccaaggctacccaacgcattattctctaccgcatttttcccagcctgcgcacccgcaaccgcgtcggcgctgctgtctcccgtcaagccccccgccagccctgctgctaatgtacttaacgcgctgatggtctgtttttctgtctcgctgagttcactgaccatttttcccgggtacaactgctgcatgattaaatcagccgctatctcacccgtcaaggcacctgcgcctcccgcaaccgcgctattgccctgtagatgtgccagaacagaaccgaccaccgcatgtgccgccagtcgcgcttcttcgttatcacccgtgctttgcttaatcacttccgccagatacggcgcactgcctcccgctatcgctttggctatatctccgcccgccagcccctggagggccgctgtcgccgcttgtaccgcctgctggaatttacccccggtgccgtaacccgatgcattgaatgcctgatcataggccgttttataaacctgaccgttgatatcttcagccgttgcaatctgacccggattggctttttcccagttggctttcgccgcctcacgatcagcctcactcacctcctgcattttttcagtcgccgcctgggtggcgataatctgcccctgtgtgcggaacacatcccccacctgactgcctatctcgccgataagctgcgcttccttcagccggttttgttctttctctttatcaaagataggggaaagggcattgttggcatgctccacatcacggctcaggtcatcaacattctgctgctggttatccgtgtcgcgcaccgtgatcgtaccttcagaaacggccgcatgggtggtgctgtcggcgtgaccttcgttattggccccgaccagcaagccgttggccatattgccaacaaactgactgccgatattccccccggtgctgatacccacactttgatgttcaaccttgaaatcggcttgattatcgatatcactgaagcccagtgtcccggtatccagcgtgtttttatcggccgtcgccgtgctgccaatcaccgcaccgtcaagctgggtgtgtccacccaccgtgatatcaaagccgcctgaaccggcaaagatacccgtctgctcctgcaccgagtcaaagttgctgttcagcttgtcctggctgccattgatactgatactgcccgtcatggagccagggctgaaactgccgccaacactgctactttgctgcttcgcatcatagttatcgctgtcctgctggctttgcagcaacaggtcgcggcccacctccaccttcaccgtttcgccgctgacctgcgcaccgaccagtgaggtatcgcggccactgtgcaccgacagcgtgccgccgctgtcaagggtcgtttcagtccaggagatgccgtcgccgtgctcacttccctgacctttattggcgttggcaaaaatactcagaccactgctggcaccactgatgcccagactgacgccaacactgccgccactgctgctgttgctgccgtcggttttttgtgtgttggcagcgccgagtagcagcacatcacgcgccgcatccagcgtggtatcgccaccggcctggagctggctgccttgcaccacaatatcgccgctgtttgccgcattcccctcaccggtggcattgatggtcagattgttgcctgccgtcagggtcgagcccgtcacgtgggtctgttcctgatgttgctccgaggacgatttttgtgagcccaaggacgcactgatgccgaacatgctggcggcatcgcccccctccgcctgcaccaactgcccggcctgtaccgcctgcacgccattgagcgccgctttaaccccctgcaatgcccccaagcggccactgctctcttcgctggccgctttcgcggtggtcaccgcggtattgacggcactgcccaccgcaccagacagtgccagcgtcaggccgctctgtttttgctcgacggtgtggctctgggtaagctgattctccgccgccagaatactgacgtttttaccggtcagattgatgtctttaccggccaacacctcggcaccttgcaccctcaggtcttcaccggcggtcatgctgacattgcccagtacgctgcccaccgtgctgcccacgctggaaatcgattgaccagaatcggtcattttggtactgctgctgcccaccgtgacaccgataccgccggtgctcatcaggcccgattttttctgttcgaacaggtgcgattcgctctcgctctgctgcgccgtgcccacggtaatgttctcctgcgcacgcaggctgatatcctggtcggccaccacgttgctgcccatcaccgcgatatttttaccgctgacatcaatagatcccgccgagagcatcgagcccaccgccagtgtctggctaagactgtcttcggtgcgtgtcagggtgctggatgcaatccctttgctgagaccggtatgattgcgctgttcgtcatgctgctcagtctgggtggtcaggagcacatccccgcccgccgccagtgtcaacgcgccatcggtttgtaccgcactggctcgcagggtgatgtcttgcgctgcctgcaaattgatatcgcccgtggcattcaactggctgccaagcagggtttcatcatagaggttcaccgagctggtatgccgcttgctcgacgattcgccggtaacgtgcaggctgtcggtggccgcgctgaggctgatgttctgcgcctgcacctcaagggtagcggcattaatgttggcccctaccgccgtcagattgtcgacgttggccgtcagcgcgccgccgacattcacttcactgcccagatggcgaatatgctcactggtcgcactgccacggccatcatgggtgcttatctggtcgcgtgtttgtaccgtctccagcttccagtcgccgccggtcgtgacctgcagatcctgaccgacattgaggcttgcgccttgcatgataaaatcacgcccggtattgatagtcgcattattgctgacattgatgctggccagcggccccaggatcgtttgatcccgcgagactgcgccattgtcgctactgagctgcgcactgtcggtgcgcaatatcacatcgcggccgctgtccagttgcaggttggtggcattgatccgcgcgctggtcaggtcgatatcgctgttcagtgtgctgagctgcatatcgccgcccgcctgaagcaagccaccacggttattcagcgtgatatcttgcgccatgctgattttcaggtcattcgtggcggttatcgcccccgcattggtgaacccctgaacctcggtcaggctgatattctctgccgcgatcaatgccccgttggcctgcagatcgcccggtttaacccccgccagatagaccacggggactaatacggtttgcccggcgacgtcacgggtttccatcagcacgatattgtgggtcagggccgccatctgctccgcactgaggtgggtaccaagggcaatattgaacgccttgctgtactcaaggcccgccgcaaacagtgcctcgaactgctcttgtgcactgcggtaatcactggccaccgcctggccggtcaatgccagcacctgatcccgcaccagccgctgttcataggcgttatcccccagacgtttgaatatcacatccgggtcattgttcaactgctggagcacgtaatctgacccgcgccagttattcaggttggcaaacgccgggtgggtttcgatcagataaccgccaccgccgacggtgtggtcggttgtgaactgatacagcccgccattcggcggtgtcagcgagatcccgttaaattcgatcgccagatctttgccgctattatcgcgatcggcaggcggtgcgatggcaccggggttggccccattgttaatggtcgtgccactgccgctgagtgtttttgcggtaaaacttgaggcatattcactggtggcgcgctcactgacttcaggtccccacgcccatgcccacaaaccgcctttgtaggttcggtagcgccagacaccgctggaggtggtctgctccatcaggcgttgctggtcaccccagccatcctgttgcagggtgacgccggtgagatcaatctcgccttgtgcactcactttgctccagaaattctctagcgtgcccacctgcggtgtcaggtttccccccgccagcagttgcgcttccgggctgatctgatcgatgccgttataggcgataaccgacgtatactctgtgccgatataatcgctgttatcggcaccgccattcggcggttcagcatagcgcccacccggaatatcggggttttctgccgtccagacagccgtgcctgtcaccgtatcggctacgataaagtcggtgttggcggtcaaaatatggcggctgttggtcagcgtcgtggcgtaaatcaacatgtctttgccggattcgatcaggccggaaaggttgagcacctgagccgcagaggcgtaatggccatcactcgcttgcccgccggccagaataaccgtgcccatgcctaaaatcgtggtggtcggcgcggtgtcagtgtgggtgacggtatcgctgttttcaatcaccggggccagcaaggctagggtgccgttttcatcggtagcaccgatcagggcgtcagggccggagttggtaatacgctcccgtgcgttaagtgtggcttcggcgctaataatactgcccgtgttgaacagggtgttggagtcggtatcaagcccaccgagggtcaatatctcgccatggttaatcaatgcgccggtggcgttgagctctgcttgcgtcgcgatcaggttgccgctattcagtaagctgtccgagcgggtactgagtgtgccccccgccaccaggtgcccgtcattggtgaccgcgcccagggatgtcaaggttaaatcacgcccggcctgaagggtcgagcccgcctggtggctgaagtcacgctgtaaatcgatggtcagatcctggctggccgtcacctggccgccttggttatcaaactggcccagatccaacgcgagcgtgttgcccgccagcgtgcccccctgattattgagggtttgagcggtgttgatgctcagtgtgtcaagggcgagtacagtggcgcgctgggtgctgatatcgccacggttggcggtgagggtcatctcacgggcttgcgtgtaactgtcggccagatcaatccggctgccggttaacgccatggcacccgcggcaagggtctgcccgtgtgcgatcaggtcctgacgggtggtcaccctcaggtcaccgatttccgtcaggcggccatcactttgtactcccgcccccagcaggctgttgccgttgctgttcaggctttccgcctgtagcgagagggtgccgcttgagaggagggtgccgccccggttatcgacatcgcccggcagattcagattaaaatctgtcgtcccggtgtgggctatcaggcccccgacattggagagtgcctgcgcgtcgagcgtaatctgttcggcgatcaggctggcgttatcggtacgcaataacgcggtggttgcagccgacaggcgatcactggctaacagttcagcgccggtcagatcgatctcacccccttgtgcggtgagcgtgatatcacggctttgcgtctggctgccactcagatcaagacggtgtgcggtgaaacgctgcgccgtgccgctgatattttttccctgggcggtgatcttcccgctagcttcaacgctcagtgtgccactggtaatggcgctgttgtcggacttcacacccgcccccagaacagaattgcgggtgctgttcacctccgccgcacggacagaggtatccccccccgccgcgagggtgccgctgttgctgagtgtacccgccgtggtgagttgggtattgccctgtgcatagagcacaccggtgttctctatatccgcggcggtattgaccaccaactgttggctgctgttgatctggccgctgttcatcagcatgccatcggccgttatcgtaatatcgcccgccgacgcccctatctcgcccgcattgtgcacaccgacaccgctttcagtgccaatcaggcgaattttaccggcgtacatgccccccaaatgggcgacatccaccgccacggttggccgcgggctgccatcggcggctttggcgttaatgttttgatgggcggcatccacctgattgcgcccggtggtgacactcagttcgttggcccagatcccggcattcactttgacggagcgggcgatcaggtcggtatgatcctgacggctgctgtccatgccggtgccctgaataacaatgtccccccgctccacatcgtaaccggtgagctggccgttattaagctgcgcctgaccggtcgtcagggtcacacggttggcgttgataaaaccgcagccctcgcaggtaatgcccgccgagttagcgataaccacctgtgccttgcgccccgccacctcgatatacccattgagtttactggggtcgcggctgttgacttcgttgaggataatgctggcctcaccccgcgccagccacgggttgccgtcgataaaaccaccgagctcggtctggttgacaccgtggccgttattgaggatcacgccgcggccatcaacatcaaactggctgtaaacgttacgtgaaaccccgccgctgctgggggcctggatattgacctgtggcgtgccgttggcgctgttgataatggtgggttgctggttgcccggcgcactggcatcggcgacaatcgccgcctgaacggagagcgagacacagcccagcgccagtaacaggctgaaacttagcgtggacaaggcactgatacggcggtgttgcgtgtgccctaatcctgatgaaggcgaagaggacgcccgaccagaagcagcaatatctgcgacgacgatcatcatcccccgcactttgttaaaaataatacggtacaggttcttattcatggtcggtctcaaaaggttatccccttcgtccttgacgccacagggggttagctgcacgcactcactcgaatcacttacttgagtaagctcatcgggatgagtttgctggctgcctacctgcaacgccaatgacgttgggtgcaataaaggagtattagtattgccagttcaggttaaagcccacggtcacggcatcggattggaagccatcgggttcagacaggggtttgccggcaaacaggtcatagcgagtattaagtacgttgccgcgaataccgacagcggcacccgccagatggttacccagcagataagcgcttccgcggccacccacttcgccataatcaaggccgacatagatctcttgcccctgtatcggtgtgtaccaacccagatcattacgcaccgtccagccacgatcagcactgagggtccgctcaccattaaagccgcgcactgaccaacggccaccaatgctgaattgatcctgtggggtcaacggggtgctgctgctctgacgctggtattgcacgttgtaatggaaattttgcgccatcaccgagaagggaatatccagttgtgcattcaattgcagaatcttgcttaacgccgtgccttcatcaaaatattcttcttgagccggaaccgccccaaaccaacgggtaccgcgctgataactcaccccggcatccagcgtggcctgcgaaataaagtggcgatgttgcagccctatgcgccaggcagatgtgcggcggcgttgaacctcaacttcggtatcattgatgtagtttttcgacgaacgggtcaggacatcgtaggtgagtgtggttttttggctggcattgcggtgcaacaggcggctgagttgcaatgacacattttcactttcgccccgatagttgtaatcgctattcaggcccgccactgtctggtgataatcataactgctggcggttatgccggctgtccagtaaccgaacggcaacgagtagtggccagtcaggttattggtgcctttatcgccgcgattttttattgagccacccgccgagacataaaactggtcactcaaagagaatgggttatccagaaacagcgtcgcaccaccctgataacggccagtactgcgagtccctgagtcatccagtgaagcggccaaacgccacattttgctctgcttccagcttagggcgatatcggtctctccgggcgcgctgccggggatcaattccatgctggcttgcactgtggggatacgttgaagattctccagcccttgctcaatatcacgcagatccaataagtgaccggggcgtgcgggaaaggcactgaacagcgtgacatggcggtcactctctggtgtcagcgccacgcggtgtattttgccgggcaccacttgtaacgccagtgtgccgctgttcaaatcctgctgcggagcaagcacccgggtcgtcacataaccatgacccactaaacggttttgtaattggctcatcagttggttaatcccctgcccgcccaaacactgacctagagcctgattagcaatacgctgtaacggcaaccaacggggtaacggttcagtgccgctgagtgtgacgcggtcaataacaaagcagggcttttccacagggaaaataaggcgatccgaagaggccgaaggtgcagataagcgcacatctggcgtcggcggagccagacgttcttccagcgcccgctgccgctcttgctgatggagagtttgctgttgaataggcgttaattccgcactctgtccggcgcgagaaataaccaacagtggaaataatatagccgtgtgtaatataaaataacaataacgcaaagagaatgcctcgcctctgaattagaggcatgtatatatagaaataattttctgcattatgctgccaatagcgtttttttcaatcaaaatatgaggtttagcaataattcaagaagaatacgactttattgtatgaaatatcctacacaagagagattgatgaaaacagaatatttattcactctgagaaaatgttaatttacgtctaaaatttatatcaaaaatataataaacaaaacattctccctttcggcttacaattaaaaaagagaataacaacatccttatttttataatttcaaacacgatgacaggcgaaaattacacagtaaaaaacacctgcaaaataaataaaaaaacaaattaaaccaataatttaacaaaaaaataaacgatagatcccgcattgaaaatttattttttcagagggctaaataagtctaaaaacaatgcgtctattttgtcataaaaaagagagcaatacgttaaaaatcctttttaatttgcaagctaaacaataacaaaaactgaagaaatcattaaagtaaacattataaaattagcgtattaatgagcatcaacattcaatttcatctaccacaagaaagccgactcaatgataaaacagaaaatcacttattagccaccctcctcttataaatctagcactaaccgcgccccttttgcccttgagcaacaaatcaaaatagatttctgactctttttttcttcatccgtaagataccgatcacggtgatcagcttcaccttccagaatcgctgtttcacatgttccacaaataccttctcgacataaacattctacctgtgccgcatgactgttttcgatagcctgtaggatggtcatatcacagccaacattcagttccacgccagagcgagccagtacgagcgtaaactcaccgccacgttggttctcagccgtaaactgttcaaaatggagatacgtttgcggtataccgcgttgtgttgccgccgttttaacggcgttattcaatgataccgagccacaggtataaatatgtgtctcaggttcacaatccatcagtaaccgcaccacatccaaccggctgccctgagaggagatatggcaagaaagatgtttagcaaatgctgaattttcgagttcagattgaaaggcattgtcatcacaacagcgaaaacaatagtgcagatggtaatgatcctgacgacgttcaagttcatagagttgggagataaacggtgtaatgccaatgcccccggcaatcagaagatggcgttgcgcctcgggtaccagtggaaataagttattgggcccagacaccctgagcttatcgccaaccttcacatggtgatgcataaaatccgcccccccacgagaatgctcactcaggcgcaccgctatttggtagcggtgcgtttcaaaaggagaattcatcaatgaataggcattactgaggtttttttcacccagcggtatctgtaccagaatatggcttccgccctcaaaaaccggcaagggcctatcattgcccgcggtgagggtaaaacgttttacatcagatgtgatgacttcaatcttgctgaccacaacgtcaaacatctgatgagacgccatagaaaaccccggtattttaagcgtgtctgcgcgagctatttgcttacgctatcagagaagacccacagcggctcactgtgggccataataataggctactcttgaaagaccttcgccaccagattatggaagtgagcaataccatgctcactgatcccactgcctttatcatcagccatgatacgcccttgaccacgatagccgcgtgatttcagccctttctgaacgctttcaaccaagcgtaaatcttccgggcgaaagacattgcgataccattcgataagcgccttctggtcttccgtcaattcttcgttcgtaaaataaatatcatagttttgcagcgtcgtttctgcatcgactgggaattcataaattacggtcatcatgcctttcagtggcggcacattgaacattgagcatggccatagccaaaagccgtggaaagaggactcttcaccctcttcaaatttaaaggacttttctgagggtttcgcatagccaaattgtaatgaccaattaccgtgcatggtgtgccagtagcgatcaatctgcactgaatcggcgaatcctgggtgagcaggctcgcagtgataacactccatatagttatcgacaatattcttccagttagcaggggtacgggtggtgaagcgagcggccaatttcaattcgtgcacatcggggcacgcttcgaaaactttatcctgtaagcccggcaattgttgttccacgctttcggcgtctgggttcatattgatgaaaataaaaccggcatactcctctaagcgcaccgggaaaagcgtcgcccgatctttatcaaaattagtgacattctcgcagttacgggcatgtgccagttcaccgtcgagcttgaaggtccaggcatgataggggcaagtaatgacattctttgctttaccttccccactgagtaattggtgcccacgatgcggacagacattataaaaagcccgcaatacgctatcacgtccacgcacgataacgatgttctcaccaataatctcacgagtgatgtaatcattaggctgcgccacttcactgccgtgcgccatacaaatccagctattagtaaataccctctctttctcatgctcgaaggccgcctgttgggtatagaaataagcaggaatggtgtaagcctcacgcgggtttgcacaaaagtcttttggcaaaacaaagtcaggatgttgattactcataatgtcacctctggctatcttggtgttataggtaaaatttttagtcatacatttagggaataccgacacggcatacaacgacatagaaacgtaaaaacagagcctgctatttatgcttactggttatgcttactggcgggtggcgccgcagtttccacgactaacattgacgcagtagcaggcggtaaagattcagccggcaacatgacttgcggggtactttgctcaataaggtgcgcgggaacatgggcataatcctgcttaatccagcggataaagccataaacctcgatcaagagaatcaataaaaaaggcagcgcagtgagcacaaccgtcgttttcatggtatccaacgaggcaccagcaaacagaatagagagagggatcagtgtaatcactacacaccaaaacagccgcagcatacgattaggatcttcgccttcccgcagattacgggtgctggttgccgccatacagtacgccaccgcatccatatgtgaagccaggaaaataatcatgatgaatagataggcagcaaggaataatttgcccatgggtagcgcactgagcagcatttgtaccgcagtctccccgccctgagtatttaagatgaggggaacatctaacgcaccactaataaactgttgtatcgcgtagctttccagtatcccaaagaagaaccagcaacccaacgaactgcccagcagcaaagcccatataacctctttgagtttgcgaccacgtgaaacccgcgtcacaaacatcgcaacaccgggggtatatgaaatccaccataaccaataaaagaccgtccaactgcgggtgaagcggccatcccccatagggtcggtgaacaggctcatttgcaggaaattttgtgtggttaatccgatggagttaatggtgttattgataatgaattcagttggccccaccaaaagcaccagaacggcaaaaccaaaagcgccccatcccaccattttgctcaggcgttgcataccatgatcaataccgatatacgaactgagggaaaaaataactgccgctaccaacatcacgccagcctgcaccgcaaagttattaggcacgccgataagcgcagtcagtccaccagtaaatgtggcggcggtgatcactaatgagatcgtcagcgcccctattgtcgcgattaaaaagatcagatcgaccagacgcccccaaaaaccctgcgggttgaccccggtaatggccgagataatccccgataaacttaaccctttgttttttctgacatgaaaatggtaagccataatcagcgaggccaacgcataagttgcccacgcactgatcccccaatgaaagaaggagtaactgacgctgtattccagtgccttcggcgtttttggcgcaatattcagacccggtgtctgatagtaataagcccactccatcaccccccaatacagggttgatgaaccaagtcccgcgcaaataaacataaacaaccatgggatagtacgatactcaggctttccctcacccagacgaatattgccgtatttgctcaccgcgatataaagtaccaatattaagccaagcagcactaatatttggatcgtcgatcccagtagccgggtaacaccactaaaaatggtctctgccatttggctgctttgctgcggaaataagctgaatgccaaagcaatcagaatgatgcagagcaaactggtgacaatcagcggtatatcttttctcgggttgttcaacatgagaagctcctgcttatagagaggtgcgctcattaaagggctgtcacctcgcttttatttttgttatggcacggtgttttatcctctgtttatttcgtctacctggttttatgcgtgtttaaattaggggtaaaaaacctcgttaccccctaggaagacaccgaaacgctgtatctcacagatcaattaattaacaacataagtatcttcttgtaacatcaataaaacaatcgtgtgttttgtgaacagataaaacacgtggcgtaaataatttcttgtgaagttagtcaggcaatttgtcaggaatagcgcgcaggtcgggctaaagaatattattctcaaaaagttaataggcattcgtccgattaaaacggacgcatacccaaacccgccaacgcaggaaaggaaaataatgaggttattgacaaagtgcccgcgacggagagaacaggcagatcgtaaagacgccgtaaatacatccatgttaggctcgagccgcgccatccttggcgcggacgctttactcctctgcctatcctcaccgttcaagatcgcgtcatcggggtttgtcagcagtctgataataaggggccaggacgataaaataggcgggaggattagtgagataagacctgcacaatggcagaacccacttgttgggtggaggcatcaccacacatatcaggcgttttagggccttgcgcaatcacctgttcaatagcgtttaatattccattatgggcagcatgatagcgctcatctccttgccccagaaaatcgagcatcatcgcccccgcccagatcatcgcaatagggttagcgatatttcttttataaatatcaggggccgagccatgtaccggttcgaacagtgaagggaagtcacgctctggattgaggttcgctgaaggcgcaatgccaatcgtccccgcacacgccgggccaaggtcagataaaatatcaccaaataagttagatgccacaaccacatcaaaacgttcaggattcaatacaaaacgggcgcacaaaatatcaatatgctgtttgtccgcgctaatttgtggatactgcgccgccatcacttcgaagcgctcatcccagtacggcatactgaacgccagaccattagatttagtggcagacgtcaggcgcttacgtgggcgcatctgcgccaattcaaaggcgtattttagaatacggtcaacgccacggcgtgtgaatatcgacgcctgtaaaaccatttcctgttcggtaccttcaaacaaacgcccgccaaccgatgaatattcaccttcggtattttcccgaaccacataaaaatcaatatcgccgggctgtttacccaccaacgggcagggtatgccaggaaacaagcgcaccggacgtaaattgacatactgctgaaaatcacgacgaaacttcaacagcgatccccacagcgaaatgtggtctggcacggtcgcaggccagccaaccgcaccaaaataaatcgcatcgaagcattgtagctgcctctgccaatcattcggcatcatctgcccatggtgttgataatattcacaacttgcccattcaatattttcaaatgaaatatctaaatcccagcgcaaagcggcggcctggagcacgttgatcccttctggcatcacttcatggccgataccgtccccgggtatggcggcaattcggtaggttttcttcatcgcaagtctcatttatcagcggtaagaattgacatctcctccatcctataattgactaatttacatacaatacaaaaactggtgatacataaaacacagatcatgaataatctgccgatactcagtgacctgcgcgtttttcttctggtagcccgacgcgcaggttttgccgctgccgctgaagagatgggggtttctcccgcctacgtcagtaagcgtgtcgcgatactggaaaaaatgctgaacgtggcattactgcatcgcacgacacggagagtcacgattagtgaggatggcgagcggacttatgaatgggcacagcgcattttgcacgatgtcgatcagatgatggacgagctgtcagccattcgtcaggagcctcagggcaccttaagggttatcagcagttttggttttggccgacgctttgtggcccccgcactctctgcgttagctcgcgagtatccccgcctggaactgcggtttgatgtggaggatcggttaatcgatctggtgactgaaggggttgatttagatatccgcgtaggcgataacattggcgacaacctgattgcttgccaactcgccccgaatcgccgcattctgtgcgcatcccccgattttctacagcgctacggcacacccaaagccctcagtgaactccccggttttgcctgtttagtgatcaaagagcgtgaccatccctttggcatatggcgcttgcataatggcaccgaagaacaatcgataaaggtcactggcccgatggcctctaaccatggcgaaatcgttcaccaatggtgcctggacgggcaaggtattgctttacgctcttactgggatgttaaagacaatattcactcgggcaaactggtgcatattctaccggagtactttcaatcggctaatatctgggcggtgtacgtcacccggctggcgatgtcggcaaaagtcagagtgagcgtagaatttttacgtcgctattttaatgagcactacggcgcagaaaatacatcggcaaatggcggaacgctgaagcgctgataaaccgcccgcttattgttcccaacccaccgcgtaatcgccctaaataaagcaaagtcgggatattcagagagaaagaattaacgtggaataaaaactcagacgtttgagaggtaaaaattacccagtgacccgaataagccggctggcattatttccgacaaagacactcacttattacccgtcgcccttcaagatgcaggggtgttagctgcccttgctcaccccagtcacttagttatctaagctcctgggggtttactcggttgctgcctacctgcctcttgaagtaacttgggtatatatctggcatactttaagcggcttccctacaataagcattcagttgacgaataaagcaaggaataaaggtgtcgaaagcttattcaaatgccacgattgtggatattgcccgtcgagctaatgtgacaaacatcacggtttcccgtacttttaatcaacctggattagttaaacaagaaacccgtgaaaaaattcatgctatcgcaaaagaacttaattacgtccccaatgcttttgctcagggattaaaacgcagtagcagccaaattattggtattgtcaccagcagtatgtataaccctttttactctgaattaattcaaacggtctccagaattgcacgaacacagtgttatcaaattatgctgtttgataccgatggcagtgaagaggcagaaatggaggctattcaggcgctatttggctataaagcctgtggaattcttttgtcaccggttcgcgatgataaaaactaccaaccggcctatctcgatttagccgaaacctatcgcgttccattgattcttattgatagagatatctataatcggcaactgagcggagtatttcttaataacaaagagatcgggttactggcggggaaatacctgtctgagcagccagagaggaaaatgctaatcattggtgggcccgcagaatcagagataacacgggtacgtattgaagggattatcaatgcgttagaaaataaaaaaaatgacgtgcatattattaatggtgattacgattttatttcacaggaagctgccgttagagattatctctcttcccctcagaatcaacctgattatattattggcttaaatggaattttgacacttggcgctattgcaatttgtcatgaactgaaaatttataataatataaaattcttctcgattgatgaaccacctaaagcagcagattatggccttcatattgccggtgtttaccacgatacccagatgctgggggagattgctgcagaactcctttttaatgccattaaaaaaccccacaacgatcaggcagtaagacgcgaattcttcaccggatctctgctcacccactaaagcggcctacgaaaatatggggcacccatgttcaacccgccgtaatggcggccattatcgcgccgccattaccctcactgcatcaacttaattactgtatcaaatttatcactgtatcaaattcatcaccgcttatttgcgccgaacggaactgagatagatcgccgcaagaataatgccgcctttcacgacattctggatataaggcgatacgctcatcaggttgaggccattattcaacacccccaacatcatcgcccctaccaacgtaccaataatcgcccccttgcctccggagattgccgcaccgcccaaaacaacggcggcgatagcgtccagttcaaacccttcgcccgcattaggttgcccactcattagccgcgaagtcagtaccagcccggccaacgcggctgtcaggccactgaccacatataccagcattttatagcgcgacacacggataccactcaaacgcgccgcttcttcgttgccaccgatagcataaatatagcgaccaaacgataaatggttgagcatgatccaagcgaacagataaacaccggccatgatcagaatggggacttgaatacccagtaccgtacctcggccaaagaatgaaaacatgtcaggtaaaccggagatggggtaccccccggtgtacaacaacgccaaaccacgggcgatccccatagaggccagcgtcacgatgataggcggcatccgcagataagcaatacaactcccattcgccagcccaaataaggcaccgactaacagagcggccatcatggctaacggaataggaataccggccagcatcagcccggcagcaatagaccctgacaacgccatgactggcccaaccgaaagatcgatccccccggtcaagatcgcgcaagtcatgcctaccgcgataatggcattaatcgacacctgccgcgccacgttagtgaggttatttacggtcaaaaaactgtcatttaacccactcattaagacaaagagcacaacaaaaccaataaatggcaacatggccgggtgatgtaataatttttcccaacgtttatggcgatggagagtgctaccgctctcttgcgtagaagaagagtgttcagttctgatcataatgcactccctgttgcgtgaagcatgatgttattagattcaatttcatcacccgccagttcggcaacaatgtgcccaccacggaaaaccaggacgcgatcacaaacgccaataatttccggtaattcggatgaaatcatgatgatagatatgcctttctgcgtcagttgttgcattaattgataaatttcagacttggcccccacgtcgataccccgtgtaggttcatcgaaaataagaatatcgcaatcgttgttaagccagcgggcaattaccactttttgttgattgccaccgctcaaggtattcacagccgtatcggcatccggtgtctttacgccaaccgcgcggattaatcgctgcacgatatcgtgctctttaccggcattaacgaagatttttccgcgtttttcgtgccgattaagcgtaatgttttgggagacggaaaacggcaagatcagcccttcggttttacggctttccggtaacagaccaataccgtgatccaacgcctgcgccggattacgtagcacggtgggctgaccattgaggctgacactcttttgatagcaggagcgcgcaccgatcagtgcggacatcagttcagtacggcctgaccccaccaacccggcaaaccccaatatttcgcctttatacagatggaagctgttttccatcacgtgttttgtgtgctgaaccgtcgcctccagcacccgcaccgaggtgtctaccggatgcgatttcaccgggaaggcattctcgattttgcgcccgaccatcagattaaccagctcttcgacattggtctcggcagtcggcagtgtctgaatataagcgccatcacgcagcaccgtgatctggtcacaaatcgtgaaaatttcgtccagatgatgtgaaataaacaccataccgacaccgagcaatttcagatcgtgcatgatgctaaataaatgttcggcttcgcctggtgtcagcgtcgccgtgggttcgtccaagaccagaatgcgcgcatccaacgacagagctttggctatctcgacaaactgctgttgcgccacactgagttgttccacgggacaatcaagatcaatatccaccgtcaggcgcttgaaaatagcgcgggccttgcgccgcatttcacggcgatctaataacccccaacgattctttatttctcgattaagaaaaatattatcaatcgtattcatataggggatcagggagaactcttgaaaaataatcccaatacccgcatcaatggcatcacgataattcgcaaagcgacagcgttgaccttccagaaaaatccccccagaatctggctgataaataccacacattattttaaccagtgtagatttgcctgccccattctcccccagcaacgcatgaacctctccgcgttgaatggtgagatcaattccatccagtgctttaacacccggaaaagatttttttatctgctttaattctaataaaggcgtcatggttatcgcttccgaagggttatcgctctgcctgagcagagcgagaattgacacgcttaccagctaaaaccttgcgcattgctactgtcgatcagtttcacttcgaccggaatagctgccgggacattggctccccaataacgggccaacgcgatacccagtgcaatacgtatttggtcacgaggaaactgtgcggaagtcgcaataaaaggtgaattgggtttcaggatctctttaatggcttctggttggccgtctacgctaaccagctttacttttgcgccattactttcgattgctgccagtgcacccaatgcaccaacatcattcacactgaaaatcccggccagatcagggaccgactgcaacatgttttcggttaccgtcaaggccgtatcacgcttctgcttgccgttttgtttggtgacaattttgatgtctgggtatttttttatcgcatcttcaaaaccccgtacacgctcaagaattggcactacggggatgccatccaggatcgccaccttccctttcccccccagtgctttcgccagatactcaccggctaaaaagcctgcatcatagttctttgaacccacgaaagagtccagcggaccttctgcttgtgcatcaacggccaccacaaccgcacccgctttattcgctgccataaccgccgattgaacgccaacggaatccgttgggttaataagcagaatatcgattttcttttgcaacatgtcttcaacgtcattaatctgttttgagacatcatgacccgcatcagcgatatatactttggcaccaatatcattggccgcctgttctaatgcctctttcatcgaaacaaaatagtcgttatttaattcttgaaatgaaacaccaataacaatttgcttagccatgacactttggctggcaaacagcatgacgcctgcgatgctaaatgacagggcttttttgaaaaatgaaaacatatattattctcctgtaggggaagtgtatttttggttatcagaacaacggtatgtttttacttcactttcatcataaaaagttaatattccacatgatataaaacggtactttacctttgagtaagataaataaaccgtcaatatcaaacatcagcagataattactaacaataattaaggaaccagaatgaccttaatagaattcgtggagtccgctagctcaaaagccttttcccaatcatctaatgaataactgtgggtgacgataccttttgaggtaaccagaccacgttcaaagagatcggtggcaatttcataactgtaaggtgccaggtgagcaccgcgaatatccagttctttacggtcgccgataatggaccaatcaacggtagtttcctgaccaaagacactgaactccacaaaacgccccagcttgcggatcatttgtaagccttgagtcacaccgatgggcgcacccgtcgcttcaatgtaaacgtcacagccatagccaccggtcaaagatttcactattttgtcagcatcttctttcaatgggttgattaccacatcagccccaaaggcttttgccagtgccaaacgttcttcaatagtatcaatgacaatcaatttcttcggtgtcttcaggcgggcaacctgtaccatgcacagccccagcggccccgcgcccgccagtacgaccacatcatccagttgaatatcccctcttgccacagtatgaatcgcacaggccatgggttcgatcaggaccgcatcttcatgactcaggctctctgggattttgtgaacaatggcattttcagaaaaacgcatatattccgccatgccaccttcagcgacatctttttggaaaccatagatattgtgcgtttcacacatccagtagctgccagagttgcaatagcgacagtcccagcaagggactatttgttccgcaatcacacgttcgccgatcttatacttcgattcggtcccttcccccagcgccacaatatggccgtagaattcatgtcccggtaccactggtggttttacccacggggtttctccccaaaacatttttgccccattcttacatttacagtcacccgcacaaatcccacagcctttcactttgatcaccaactctttggctttcggcacaggtgtcggcacgtgttctaaacgataatcctgcgggccgtgacatacgacagcgctcattttctcaggtaactgactcattaactcctccaatagcaacagaactcggtgtatggatacaatgttgacgttgtcatttttgaacaaatcaacaaaagtaaaattgctgacttcaacgctcaataatgacatcgcattcataataaatattgaaatgacaacgtaaacattgagtatcatataaccaaattggcagaaactatttgttgaacaaagtcacacgctgttaaattgatgttaaacaaagtcataaatttagatcctgatcgcaacaaccgtctctgctgtttatattaaacaattaataaaaacaattaatacattgaaaaataatgataaattattttttaggaataactgttaaaaataacgaaaatgaataatcaaacaaactcggtcaaccaaagttgagaatcatcttgaaaaagtagggtaaatgcccagataaaatgcggtaacttaattattgtcagcagtagataatctgagtgacagtgaaggtctcaattcaaaaagacaaaacgtcggtgacggtgagaaataaaaaagacagaccgtggcaagtattgagttattattcaatatgcacagcctgtcattgtatacccattacccttcaagctgcatgtacgttagttaccttcctgcaattcgatttttgggtatagatataataataaaattattcacggggtcatggcagaaaaccattgatgatagataaaatatcaaaccagcacataattaatatcattaacccaatcagataatttagtttctgtaatttacacctcttacaggattatttatactgttcatttagtccgttatataaataagacgacacaacccaatatagatgcaataaaccctgcaacaggacctccaatcttacaacacccttctcctatatcttcactggaacaacctgacttggaatttttagcattattatatttcagcgtaggcacttcatggccctcacttaatgattttatatctccatgcacagggcttttatcttttgtatcaataattttctttaataattctttataatttttgggtgcgtcttctattgaatcagaaaaacactggtgtattttatacaaataaattaggccatttatataattatctctatctgatttatcatacccaggccggaactctagcatttccgctcctgttttcttatgaatcataacctcatagatcttctccctgagttccgctgaaatttcaattaactgtctaaattcactttttaactccttaagactttctttgattgacgtcgtattaacgcctttttggtgagcatattgtataattgattttatttcatttaacttactttcttgctctgaggttaacctacattgattaatatcagaatcactcagagttttacaaggagtatcttttacatcttcgatatttgaacatgaataggttggtgaaaaatctgcgctaatacatgctggcatatataaaaccttattaatataaaataaatagattgattaaaaaacaatcaacactgacgggatgccaatatccccctaaaacacaggctattgaacatggtaataaactgattaccaaaacaataacctgtcaatataggctaggattaaaaataaaaacctaattatttacgataagtattttatccaaactgaatgcgaccaaggttataaccaagattaggaacatcactgtttttattcagcgccattaagtcaccataaatagaacccgaatggtgtaaatcaacaatcctctctattgaatcagcatattttttaggtgtatactcaatttcatcactaatgacctgcttaatctgattataagcaatcaatttttctaaataatgttctctatcggttgcatcatatccctctcttaactgggctattcggccacctccccgcccatcattgggaacaagtttataaacctgatttcgggtatcggatagctctttatacaatgcatccattttattacttaattcattaatgcattcttccacaatagcgccgtccattttcctggcacaaataaccagcatccaggcatctaccttttccagaaaagcctctgtacttgcggtttttatgtctttattaagactactgtcttttactaaacccgttgatggttgttttacactctctgcagcgggtctgctagcggtaagccatgattgaagcattggttgaatacgacctggcatagaataactccttgtggtggttaagcccttattgggtgaaaaataaggacgttcaatgttgataaggagtattaattatttttaggggatattcttttatattaaatgataatttttggttatgcccccaagcgccattactttcacttacttaccttagtaaccattaaaaacccccagcaaatcacggctgggggatgataaaaacacgataaaaaaccaaatggctatggccagctacaaccacttggcatcacgcgtaaaggagatggttaaccagcggtgaggcccagactcaccaatctcatgggcgatctcatcgcggatagtatcgaaatgatgaaccccgcgggtatccatttctggcgggatcaccacgtggatctcgataaataaaccacggccagcgcgggtggcataatgcgagtaatcaacaaatttatatttatccaccaggcgttccatcaaggtctcaatcgccgtatccagtgtatcgggcgtcatttgtaaaacttcacgcactgccgcaatcactgttttaattgggaccgaaattaatactaacgttaacagcgccagtaccatggggtcagcataaacaataaggtgttcatagcgcgtaccttccataccccatgagagtaaaaatgcaactaacagcgccgtactgatacaagcggacatgaaccaactcttcgtatccaatgcaataagctcggatttcacccgtttattcaagcgccgctgttttaaataaatggtgaaacaaaaaatactgacagccaatgtgtagacaatggcccaaccgagctccaattcccgcccgccatcaaaaataccttttatcgcattcacaaaagcgtaaagacaaaggagggctaataagctgccattaaaggccagaaccaacggttccacatgccaaaaaccatattgaaaacgtcggctatgcggttgaccaagtagccgagagaccaatagagataaactgcacatccccgcatccagcgcggagaacataccatcaaagacaatcgacattgagccacatacaataccgaagacgatccccattactgcaataatcaaggtataaaaaatcgagcggcgcaagatttgctgttcaagctgagtatcctgcaacatgggaggagcttgctcactgagtgttgtcatgtgtacaacctgtttttttgattttaatttagcttgatgagtaaactctcatattaggaatattattacatcaactcaatttaataagatcacatgccaagattaaagacgccactcaggccatcagataatttttattgtggtaggtagaaataattttttattgtgataatcagtgtagatatcgcgctatgccagcgtaacgctgtagtgcagataaaaatagcaggcaaaaaaaatccgctcgaaagcggacttttatcagacacagtatttcaccgttgaaggccaatactcaatagctcaggctatcacttagaaagtgtaacctacgccagcaacccaagtacctacgtcaacgttacggatacggctctgctcgtaagagacatccagagcaacgttttcggctgggttgaactgcaagccagcaccgtaggtgaagccgtagtcactggtgctgtgtttatcaccaacgaatgctgactcgttttgggtgaaacgaccatgacccacaccgaccagaccataaatgctagcccaatcattgatgcggtatgctggaccaccggtaatcgcattatattgcgctttgttgtaaaccgcttcgtcaccgaaaccgcttttttcagtgtgagtgaaagaggtgatgtaacccagttgagagtcactccactcataacggtatttcaggttaaaacctgaagacttgttcgcaacaccttgataatcgctctgggcataaccaccagaaacggtgctttgacctgcaaaggcagaacctgcggtcacggctaacacacacgctgctaccgctgaaagacatgcaatttttttcataaccacctcgaaagacgcaaattattgagtgacacaaaaacaccgtgcgactatagcaataaacaggatgaaactctgttatatattaattgtctaattaattatttcatgtaacaaagaatttcaagaatcatccatcttactaatacatctcggattttgttataccttactgcagtatgtgacctccatcccccaaaaccattccagataattccgaaccattatgctcaattaatcacccgaaatggggtaaaaaaagccgccgtctgtgtttgatttttcttttttctcttttttattttttctcttttttgccgtttgatgatttttcaacactcggttggcatttcatttacactggaaaaactcacgcataactcttttcttcgaggctccaaaggatgtcgttgtctccttcttctaaaaactcactgccattactccccattttgttgctcgtgatcgccatgatctcaatacaaagtggtgcatcactggcaaaaagcttattcccactggtcggtgcacaaggtattacctcgctgcggctcggcatcggtacacttattctgtttgttatttttaaaccttggcggatgcggtttgctgcaggcagccgtttacccctattaatttatggggtggcattaggtgggatgaacttcttgttctacatgtcgttaaaaacggtgccattaggcatcgctgtagcactggaattcacagggcctctagccgtcgctatgttttcttcccggcgcgcggtagattttatctgggtggggctcgccattctggggttatggttcctgttaccactggggcataacattggcaccattgatttatttggtgcagcctgtgctttaggtgcaggggcctgctgggcaatctatatcatctcgggtcaaaaggccggaggtgaccatggcccagggaccgtcgcggtcggctcgttgattgcggccttgattttctgcccaattggggtggcctataacggcatggcactgttcgatccggcgatcttgcccattgcactggccgtcgccattttgtctactgcattaccttactcactcgagatggtcgcgttaactcgccttcctgcccggacatttggcacattaatgagtctggaacctgcattagccgcaatttcaggtctggtgttcttaaatgagcatctgaccttggtgcaatggctcgcgttagcatcaattatcagtgcctccgttggtgccagcctgaccataaaacctaaaccacaacttgaccaggtcacctgataggaggagccatcaatggaaatcagaaccgcaacgcccgccgattttgctgagatatggcctctgttccaggcggttatccgcagcggtgacacctacgttttcacgcccgaaacacccgagcaagatgcgtatgattactggtttggtcgcggcgttcgctgctgggttgcagtacacgagcagcgcatcgtcggtatgtataaattaatcgataaccagcgcggcctgggtgcccatgtagcgaatgcttcatttatggttgatcagaaagtgcgcgggcttggcattggcaaggcccttggcctacattgtattgaccaggccaccacgctcggttaccgggcgattcagtttaattttgtcgtcagcacgaatacactggccgtcgcgttgtggcaaaaattgggcttcaaaattattgctacactgcctgaagcgtttaaccatcgccaactcggttatgtcgatgcctatgtgatgcatcgggtgctggtgccaactcagtcctaacccgagccatcggaggccatacatgcaagattgggatcctgatttatatcgtcaatttgaagccgagcgcacccgcccagccactgatctattagcgcatatcacgataacctcgccgcagttcatcagcgatttaggctgtgggccaggtaactcgactgaattactgcatcgacgttttccagatgcccaattggttggtattgatcattctcaggcaatgttagccagtgcacagcaacgcctgccacattgcacctttattgaggcggatatccaccaatggcgcccttcacagccgcagaaccttatctatgctaacgcctcattacagtggctaaccgatcacccgcatctgttcccgtccctgctttcacagctagccccaagaggggtgctggcggttcagatgccggataatctggatcaacccagccatcgcgctatgcgagaagtggccgagaacggcccatggcaacaaaccttacaagaagccggcgcaacacgggcgaaagtgctctcggccaatcactattatgatttactggctccccacgctgagcgagtcgatatttggcgtacaacctattaccacccgatgccatcagcgcaagcaattgttgactggctgcgggcaacggggctacgcccttatcttgcccccctgactgaagccatgcagttggcgttcctacaaaattatctggccatcattgataaggcttaccccgcacggactgatggccgccgcttgttggctttcccacgtttatttattgtcgcccatgctcaaagataaccccttatattgccggtagaataacctgtccggcatgcccccctgaaataagaaagtattcaaacaattcactaactatattatttataacaaacgttattttagcgtataaaccccattcaaatagcttgtgaaattagactgaaatagcaaacgattaatttgataggcaacatctgacctgcaaaataaaatacctttgttatacttacttcagtgaaagacagataaccaactctattaaggagatatccattatgagtacagcaaaactggtaaaaacaaaaccctccgaactgctttatacccgtaatgacgttgaggagcatgttaaagttgctacgattaagcgattgaaccaaatggtcattcagtttatcgatttgtcgcttatcaccaaacaggcccattggaacatgcgcggtgctaactttgttgctgtccatgaaatgctggatggcttccgtactgcccttaccgaccatctggatacctttgccgagcgtgctgtacaactcggtggtgtggcattgggtaccgcacaggtcattaatgataaaaccccgctaaagagctacccaaccaatatccatagcgtgcaagagcacctaaaagcattagccgagcgctatgcgatagtcgcaaacgatattcgtaaagcgataaccgaagttgaagatgaaaacagtgcggacatgtttactgccgcttcccgtgatctggataaattcttgtggtttatcgagtcaaatattgagtgatcacaccgctggtaaccttctattacgctgaacagggccgttaaccggccctgcttgccgccctcctgtgactcgaattattttgagtctcgttgttcactctttccttgttaatgtgacagaacctataaatatctcttttcaatagagagattattttagagaggtgttaatgttttctcattagcattattcactaaggtagcgagaaataaataatttaaaaaaaccacttgcacccctgcccgttgccaataaattttaatgacataattgatacctctgatacagattatatttttaacatggagaataaataatgaagaaaaattgtttaaaacattatcgtgctgggcagcttttagtgttggctatcggtttggcgttttctgtacccagcgtagcgctaaccgatgttgctcaacctcaggaacgctatgaaaattatgtcacacagcgtcagaccgttgatttactgatcaatcaggcacaacaagcctttaaaaatcccactcgaatttcaggtgcagggtttacaggtaaattaccctctaatatggaagtggttgcacagaagttattacaagcacaccaactcgagccataccgtgttgatctcttatttagtgcagcaagcgcatatatttataataacaatattgaaaaagcattagcgatttataaagatattttaaaagatgcgccggatgatattgatgcgctgatttatctctctgcatggtcacgttttgcgggccaaacatcagaaagccagagctattttgcacaattaaaacggcttaatccgctgaaagcacaacaacttgaacagttttatgccgttatcgataaagccgccgctatgccgatttcagataccttatcagcacaacagttggcgcagttgaaagcgacccaaggcgaaaatgcgattgtcaccttgggctatgcgttaaatcctgatggtacgatgaatgatgttcttattcagcgtttagaaaaaacgttagaaattgctcaacaattaccagatgcgttaattattgtgacgggaggcgtgccgcaaaataaccaaaccgaaggtaaattaatggccgattggttaattaaaaaaggcattaaacctgaacgtatttatcaggataattatgcacgttctaccgtcgaaaatgcgttatatagccgttatgccttggcgaagcatagaattaaaaatgccatcatcattagttcaggaagccatgttcgccgtgccgatgcgttattcactattgcaagttgggaaagtggcccccacgatattaatttcctgactattgcggccttggataagcccttaagtgaattacagaaaacaagcccagccgatctacagggtatttatcgcgatggcctgaaaacactgggtttatggagtttccgtagttacccacttgaggagcgttaatcattacatacccgtagtccttcaagatgcaggggtgctagctgcccctgctcaccccatcctattttctctcctgtttttttaatctctgggcagaggctaaaaatcagaattggctgaaatctcccggcactgataagaaaattagacgtcatcgacatctttgttaaattaatgttatgtatcgatggtttgttgttgactaccgcgctaataattagtagataatggattagttgcacaaaaatgacgctatcgcaccttttgggtgtcccgtgttagtgcagcctttgctagctaagtaattgcaagctaagtgattggggtaaatctgttattttttagtatgttgcatttctggcacgatcttttcatattgttatctgaaatataaaaagcggacctctatacccaaaataattggtgttgcagccaagcggtaaacacgtaatgcccgatgaactgacgaatatatcagtaaattggataagtaggtgctgctgctcgtcgcgctgcaatctcaagtaaaggagggtatctccataaaagcacaaaggaattcccacttatgaagtcacttgtcaaagtttcattggccgcactgacgctggcctttgctgttagcgcctacgccgcagaaaaagagttaattgttgctacagacaccgctttcgtcccatttgaattcaaacaaggggataaatacgttggttttgatatcgatttgtgggatgccatcgcgaaaaaactggatctgaagtacacgctaaaaccaatggatttcagcggtatcattccggcgctgcaaacgaagaatgtcgatctggcactggcgggcattactatcaccgatgagcgtaaaaaagccgttgatttttctgatggttattacaacagcggcctcttggtcatggtaaaagcggataataatgacattaaaagtgaggccgacctgcaaggcaaagtgttagcagtgaagagcggcactggctcggtggattacgccaaagccaatatcaagaccaaagacttgcgccaattcccgaatatcgataacgcctacctggaattaggaactggccgtgcagatgcggttttacatgatacgccgaatattctttacttcatcaaaaccgcaggtaatggccagttcaaagcagtaggtgagtcgattaaagctcagcagtacggtgttgcattcccgcaaggcagtgacctgcgtgaaaaagttaacgcggcactgaaatctctgaaagaagacggcacttacgctgaaatctataaaaaatggttcggcgtagaacctaagtaatttattttgccgtatttatatcaggagactatccatgcagtttgaatggagcgctatttggcccgccatcccacttctgcttgaaggtgccaagttgaccctatggatttccgtcctggggctacttggtggcctgattattggggtgatagccggtcttgcccgcgcctatgggggttggctgagcagtcatatcgccttagtttttattgagttgatccgcggtacgcccattgtcgtgcaggtgatgtttatctacttcgcgctacccatgatgataccgctacgtatcgatcctttctctgccgccgttgtgacgatcatcattaactccggtgcctatatcgcggaaatcacccgtggtgcggtgctgtctatccacagtgggttccgtgaagctggtttggcactcggtctctcccaacgtggaactctgctttacgttattgcgcccctggcactgcgccgtatgttgccaccgctaggcaaccaatggatcgtcagtatcaaagacacctcactgtttatcgtgattggcgtagccgaactgactcgtcagggtcaggagattattgccggtaatttccgcgccatggaaatatggagcgcggtggcggtgatctacctgattatcacgctggcactgagcttcgttctccgtcggttagaaagaaaactgaaaataatatgattaacttcaaaaacgtctccaaacactttggcaaaattcaggtgctccacgatatcaatctgaatatcactcagggtgaagtggtggttattattggcccgtccggttcaggtaaatcgaccctactgcgctgtatcaataagctggaagtgattacccgcggccagttgattgtcgatggtttggatgttaatagcccccacgtcgatgagcggcaaatccgtctggaagccggcatggtattccagcagttttatctgtttccgcatctgactgccttggaaaacgtcgcctttggcccaacaaaagtgcgtggcacatccaaggaagaggcaaaaaaacaggctctcgcgttgttgtctaaagtggggttggaagaccgtgcccaccattatccggcggagttgtctggcggccagcagcagcgtgtggctatcgcccgtgcactggcggtaaaacctaagctgatgttattcgatgaacccacatcggcattggacccggaattacgccatgaagtcttgacggtgatgaaagatttggccgaagagggcatgaccatggttatcgtcacccacgaagtgggctttgctcagaaagtggcatcgcggctgatctttattgataaaggccggatagcagaagatggtgatccagacagtttaatctccaatccgcccagcgaacgtttacgggaattcctgcaacacgtttcctgatctgcggtttaatattcattcaatggaatgttcattcaagtaaatgttagctcaatttggtattggctagaaatcacactggcggacatcttactgatacccgccagttttttataggctatcgatcacttattcctttcgttcacttatcccttacgatcacttaccccttgcgatcaattggccctttactatcactatcctttgatagaaatagccaccgctcgtcacactggtgctcgctgattttttacctgagaaaaagtggtcattaatttcaccacatcttgcatccccacattgaccagattaatcacctcaccagcatcttgtgtcagtatcaccccgccccccgcctgctcaacacaggttcccatccctttgatcgcggcggtaaccccattctgaatggttttagtcatttgctcgatttcactcgccgccttgcgcgattgatcagccaacaagcgaacttcactcgcgactacagaaaaccctcgcccatgttcaccggcatgggccgcttcaatcgaggcattgatagccaataaattggtttgtgatgaaatcttgcggatagcctccacaatgctgccgatctcttgcgagcaacggcccaaatcgctgaccacatcggaggtttcacgtgcaatagattccacctcttgcataccacgcactgcctgctgaacaatttcagccccctgtgaagcggaacggtcagtggtcaatgataaatggtggacatcgcggatcaggttctcctcctgctcctgttgcagcatcaatgcggtaatatcctgcgcaattttcaccacttttagaacgttcccttcattatccatgatcgggttataactggcctccagccatacccgctcaccacggcgattaaggcgttcaaagcggccgataataaactcgccactggccaagcgctgccagtgctggtgatattcctcggagtgggcaaactcaggcagacagagtatctgatgagacttatgctgaatgtctgccaatgaatacccaataacatttaataaattgtcattagcagccaaaataatgccttggggggtgaaggtaatcatccccattgagcgattaagtgcctccagcaagctttggtgttcctgcgattgtaaaatacgctcagtaacatcactggcaattttaatgatttctatcacattaccttggcgatcaacgaccggtgtataggtcccctgtagccaaattacgctgccatccttgcggatacgcttaatattatcgctaattggtcgcccttcattaagcaattgccaatggcgacgataagcgtcactggcagcgtattgtgggtcacaaaatattttgtgatgtttgccaatcacctcaccctcttggtatcccatggcagctaaaaataacttattcacctggattaccgtgccatcaggtttaaaaataatcatggggacagcgttatcaattgaggtcaattcggcacgccagggggcatgagatgagcggaaattaaacagcataggttaagtccttatgatgaatgattgagcagcaaacagaaggaatgcttatcaacatgctttacccgaaaagaaatattaatcagactgctgacaaaccccgatgacgcgatcttgaacggtgaggataggcagaggagtaaagcgtccgcgccaaggatggcggctcgagcctacatggatgtatttacggcgtctttacgatctgcctgttctctccgtcgcgggcactttgtcaataacctccttaatgaaatattcttcagattttactcttcaccctggacggtaaaaatggttgagataataaggtgcaaacacgacaaaaatcacaataattactgtttttcaaatcttgtcagctagggtgccgactaagatttatcgccttcggactgggcgctaaactggttagaaagactaatgattttgagtgtatcttaatgagcctagactaaagcattggaattaacaggtaggttgtttgaaagaaataaaaataatgatttataaaaatatctttataaaaaaacaaattaacgcagactattaccctgtgataacagaaataaaaatggaaaaataaaatggtgtccgcagggaattcttttaaggcagcattcaatattagcgtccattgaatactgccgggtctcgccttaccccatagcgttgcgccatgctggttcgttaaccacggtaacgggttgatcgtgatcactggctgatcgtgatcactgacttgtcgtggtcactggcttatttggcttatatagtggaaacgttatgcccagcgctctgcaacccacgcggcttgctgctcgggcgtcaggaacgtccaggccacaaaccgactgactttttgcccttgcgccatctcaatagtgcgcacctcaactgccttcacatatcttaacgcatgataaatcgccggtaacgtggtcttcttggaaatcaatgaggtaaaccagaagcagttctgcgctttcgctacgctctctgccaccatgcggctgacaaacccttcctccccaccttcacaccataattcactgtttttaccaccgaagttctgtactggctttgcagcgacttcatttttccccagtttgtgcaatttacggcgagtggtggccgccgcttcttctgctgaaccatggaatggcgggttacacagcgtcgcatcgtaacgctcattcaccgcccacaccccttcaaaaatagcgtgtggatctttttgctgcttcaggcgcaaggtatttttcagggtcggattcatcgacaccaccatttttgccgcactgagcgcgtgtgagtcaatatccgtaccggtaaagcgccagccgtactcccgctgaccaataattggataaatacagttagcgccgacgccaatatccagcaacgcaatattcttgcccttagggatcacctcgccattgcaactggctaatagatcggccagatggtgcacgtaatcggcacgcccaggaatgggaggacataaagaatcggctggaatatcccaatattcaatgccatagaaatgttttaataatgccttattcaacatttttactgctaatggatcagcaaaatcgacagaaatatcaccataggcggtcggggccaaaaaagggattagctcagggcaactcactgaaagcgcatcaaaatcatagcgtgagcgatgacgatttcggggatgcaatccgcttttttctttggggaatacttttttattttccatcgtactggctctctgataggcattttctggcgcgtaagatagcataaattacggctaaacgggtgtacgggtgtacgggtgtacggtgaataggttctacaccaccagcccctttgtgcggccgatgtcaaacaacatgatgatccgctgctggcccatcgcctgaatattatcggtgagccgttcgaggcgatctacacgttcaatccacaaggccaagccacaagttcaaataatttgattgatttgctcaattctatccggttttaaaatttcgcttaaggcgtaacatagcttttatcgaaagggagcgccctttcaaccttaaaaaccgaataggatcatatcatgaaaaacatcaaaaatttcgttgcagttatcgcattatctactctttctttcggtagtttcgctgccgattatgtaaacagccaaaaagcggcacagttagaaccagtgggcgtcatcacggctaacggggcaaccagcttgagcagcctgaaagcacaactggcagagaaagcagatgctgccggtgcaaaagccttcactatcacatcgacaacaggtaacaacctgatgcacggtagtgcggttatttataaataatcgactaataataactaattcattaataacaactgtcgccaaatagattgacgttgtagcaaggcagtaagtgaacgcatcccaataaactggctcatgtcagtgatgcaataaatagctgccaacaccttggaaatacaaaagcccatccgttcatctgatgggctcagactgctgacaaaccccgatgattcgatcttgaacggtgaggataggcagaggagtaaagcgtccgcgccaaggatggcgcggctcgagcctacatggatgtatttacggcgtctttacgatctgcctgttctctccgtcgcgggcactttgtcaataacctcagcccatccgttcatctgatgggctttttctggtggtgaaacagtaaaattacacaatcttaatttgttgcaacgccagttcgacagaatcagcctgccctgccgcgaccagacaacaagctaactgttttagaatcgagtctggaataggctgctctccggccagacagccttcaatccaacgtgccgtaatcacggcatccttcgaccacggtaactcagggacaaccgattctgatgaacgatcgagtaaaattgtctgttcgccatcattgatataatgaatcggtgggcagcgcagtggattagcataaacctcgccttcggtgccctgtagcaatagccccggagcactaattgcttggaagaacccccccactttttgcatatattcaggatgagagacgctggcaacgcgcaacgctttatcatgagtaaacggtgttgccagctttgccaaggtgtggctactgtttctaacccccatacgccagcgttgttgtaattgctgatccaattgcatagacagtgcggagacagggataaagacgggcagcccattatctaagcgttgttgagcttcctgcgcacttagcgaccagggaatattcagttgctggaaaatttccgcactggtaacccggctactatcttccgtcacgccgtggaccacgaccggcaaaccaagacgcgacagcagcagtgccagcaacggggttaaattggcctgtttacgcgcgccgttgtagctggggatcaccaccggtaatgggcgatccaccggggcgcgtagtgacatcacctgctcttgcatcgcctggtaaaagcccagaatttcctgctctgattcacctttgatacgaaaggcgatcaggatgccgcccaattccaatgcgggtacctgccctgccaacatggctttatacagtgcataggcggttggctgatccagatcacgggcatggttcttaccgcgcccaacctctttgataattttactgtaatccatggtgcggcctttcccctatgggtctctcgttaacaataaactgggctgagtttgcctgacatgctctatctttcgccaatcttctccccttcatacttgccgcgcagccagtcggccagttgctgccttgagatcttaatcccgccacgcttcaaaaatgtgggtagccggtaaaaagcaatgggccgctggaagacagccaatcgtggggctaaccaatcagctaaagccacgacatccacctcatcagcagaatcaatgaccgccactggccggtgaccgaattcagcgtcagcaacaggaataacaaaagcgtgctgcacccctgaatactgcaataaaactcgctcgatgtcttctggctggatcccctcgccaccactgaaaaacagattatccaaccgcccgagaatacataattcgccttgctgccacctaccgcgatctcgggtatggaaccacccgtcgctgtccgtgagtggcagtaattgcccctgctgccagtaaccggcagccagacaatcggcttttatccagacttcatcgtctaccagtttcacctgacggcctgcgagcgcgacaccgacaccaggtcgcccgtctgcccgcttggcacagaccgttgatgccaactccgtcaagccgtagccacaccaacagcggatgccgtgggcctcggcctgttcggtcagttcggttgggatcatcgcgccccccaacagtacctctttcaacgtcaaggggggggcggcattcgccaacaaacgccataattgcgtgggaactaatgacgcatggctgcaccccgccaaagcctcaaccagtggcacgccctcttgtacccccagtgtcgcccccgccgtcagccaacgccagacaatcccctgccctgagacatgaaacaacggtaacgacagcaaccagctatcactggcggtgaaattcatcagcgccagtacgccgtcggcattagcccgatgtgcgcccagcgagtgtactgcggccttcggtaagccggaggaacctgaggttagcgtcagcgtcgccagccgttggccatcccacgctatcggggtcacggctgccgaatcaacggtgcggggatccaacggagtaaaggcaaaatgcgggggcaacggggtggctaaattcagcataaagtgaatatccagcgttggcaggcgctgcgccaaaagcgcatccggtaattgcggattcagcggcaaaacgcgagccgcacactgcaatgccgccagataagccaatagcagggtataactgtttttaccgcgcaaggccacgccgctccctggcaccacaccttgctgttgaaaagaggccgccaacgcattgatatcactggctaactgttgccaactgatccgttgccccccagaacgtatagcgagcgcttgaggccgcagattggcccaatactgccaaggccaatgctcccaaggcggatggcctaacgatgccataccacgcccaactgctcggtcgtgattagcggcaacgggctgtctggccacggccgcacgacttgcgcctgcatcaggtccagcgtatccaaccccggaaccgtggcgggggtcaaccaagcggccaaacgggccaattgcgtcagacccagactggattcaatactggagctaataaccgcaaccaaaccggcctgatgcgcttgttgcaccagttgctgacagcgagcaagactgcccaccagcgttggtttgatcacaattgccgccactcccggctcggcttcaacctgaaaatccgcctcacgcacactttcatcccaggcaatagcaataccggtatcttgagcaaactcacgggattcagcgcgggttttgcacggttcctccagaaaggcaatacgcgaacgcagcgccggattgacatacttcgcgaacccatcggccttcgctcggctccaactgcgattagcgtccagccgcagtgtcagatcaggcagggcttccaacagaacattaacgatcatgccatcacgcaccgcttcatacagcccgaccttcaccttggcaaccttctcacccggcaatgcctggagtaccgcaaacagctcatcaggatcgccggtacacagtgacgctttgcgataatccgctgacagcggtaaggtttgcttgagttcggcctgcgcacaactgagaccaaaagccacggagggcaacacgctgtcatccgattcgacaccactgacccagtgctgcagccaacactctgccgccacttgggcttgatccagtgtttcttgactgaattccggtaacggggcaatttcgccccagccgctcaattcaccttgctgtaatttgaccagcaacccatcgcgacttttcagccgctgatggcgcagtatcacccccgcttccatcggtacactgtagcggtaaagggtagccgtgcgcattacggattacgcttgaatttgctgaagtccggctggcgtttttcattgaatgcgttacgcccctcctgcccttcatcggtcatatagaacagcatggtggcgttaccagctaactcctgcaaacccgcctgaccatcgcaatccgcattcagcgctgctttcagacaacgcagcgccatcgggctgttttgcagcatttcacggcaccagcgcacagtttctttttcgagatctgccagggggaccacggtattgaccagccccatatccagagcttgtttggcatcatattggcggcacaggaaccaaatttcccgcgcttttttctggccgacaatccgcgccatatacgccgcaccccaaccgccgtcgaatgaaccgactttcggtcccgtctgaccaaaaatggcattatctgccgcaacggttaaatcacacatcatatgcaatacatgcccgccgccaatagaatagccggccaccatcgcgaccaccggttttggacaggtgcggatctgacgttggaaatccagtacgttcaggtgatgaacaccactgttatcctgatagccgccgtaatcgccacgcactttctgatcaccgccggaacagaaggctttatcgccttcccccgtcaaaataatcacaccgatattgtcgtcataacgggcatcggccagcgcctggatcatctctttaacggttaatggacggaacgcattacgcacatgtgggcggttaatggtgatcttggcaataccatcgttggatttgtgataacgaatatcttcaaatccggcggagcaatccagccagtcgatggcggcgtacaattgttcttcgctcggataaagcatagtaaacattcctttaacgagataatgatgacggtggtaaacatgatgactgtgacaaaaatgccagcacctgtgcagcaaaagcaccgggattcgcccgatgggcattgtgcccggcgcgggctagcgtgtgtaatggcaatcgatattgctgtgccagttgcaggaacttatggtcacgatcaccacacaaataagtataagggacgttgagccgttgcagggccggtaacaaccacggttgatgccctagtgacgttgcctctagcatctcggccacagccgtgccatggttatcggcccgcaataacaccagttgttcacgttgttgtggatctaaatcggcaaataccgcctgctgataccagtcatccaatacctgtggcagaggctcctggcgaaagcgctgcgcccattggcggtcttgttgcaaccgcgcctgacgtagttcagcgttttccagcccgaggtttcccccttcaaccaataacccctgcaagccatgatggcgaccataacaggcgtgatatatcgcgatcctaccgcctaaagagtagccggccagccagtattcgcgaataccgttagcctgtaatgtttgtgacaactggcgactgatatcggcaaaaccatcggcgctcagggagacggattgtccatggcctggtaggtcgatcaacaatgacggataatcgccacacagttgtgccacgggcagccaatcttgcccgctgcccaacaaaccatgtaaccaaaccaaccaaggcccggcgtgttgatggcggggcgattccggatgaggggccagtttttggcaagccagtgtcgtcatggggccacctgcggtattaatgtcacctgttgtactaactgttgcagtgtttctgccccctgacttggtggcacctggacttcaatcagtgtggttcccccccgtagccagcattgatgcacgtgctcccgtagctgaggccagctattaggccgggcataacctaagctgaacataaccgctgcgtgttcgaagttcacatcctgcggcatacagtagaaacgctggcgctcggcctctggggttggcaataaagagaaaatctgccccccattgttattgatcaccagtagcaccatcggtgccgagctctggcgcaaaagtgccagcgcattaaggtcatataaggcagacaaatcaccgacgatagctaatgtcggtttcgccgtcgcgcgctgtacaccggcggcggttgacagcaaaccatcgataccactggccccccgattgctgtaaaccggatagcctgcgggtagctgccccagcgcatcaatcaaccggacaatcaaactgttgccaacaaatagctggccgttatccggtaataattccgcgagctgatgtgccacggcggcctcactgaattggccggacagcgtctcgatcacctgtgcttgcgcactttccgaatacaccgccagttctgtggcccaaggtgtacgccgctgcgcggggtgccgactcaaccactcgcctaccgggcaaataatacgtcggccacgatgattagcaggatcaaggcggcctggggcgctatccaccagccagtattcctgtggctgacatgcagtctgccattgcaaaaggcgcttactggtcagactgctgccaaattgcaacacaatctgtgcttgagcgagggtttcttgcgcccgtgggtgcgccagccataagtcagcacaaggcaatggctgacccgtttgtgacaatacatcgccaatcagtggccagcccagcattgcagcccatgcagtcagttgccggccctcttccgcgcccatccgcccggcaatcacgactccacgtttttgccgccagaaaaaccagtcagcttgctgtgcaagtggttgataaagagagggcgggtaacaggtttgacgcagccatgggtgacaatcctgccaccaatcgcccagcgaggcagaccagtcggcatactgttgctcatcccccccatacagtggttcagcaaagggacaattaatgtgcaaagcgccatgttgcaattgcgccatcgcgctgtcgagtgtggaaaccaaccaacgggcagagatatcgggcgtcggtctggggagattaacacttagggttggatggctggcaaacagcccctgctggcggatagcctgattggcaccgcaatcgattaactccggtgggcgatcagcggtcaataatatcaaccgctcacccgttaaccccgcttcgattagcgcaggataaagattcgccaccgccgtacccgaggtgacaatgaccgccaccggttctgttgaggccttcgccagccccagagccagatggcccagaccgcgctcatcaaaatgggtatggcaaaccaacgacggattagcggcagccgctaacgttaacggtgtagagcgagaccctggggcaatacagatatgacgcacaccgtggcgggtcaaagcctccagtagcagtgccgcccaacgacggttaaaaacacttgtcgacatggtttgctcaaaagtcagttaacagacgctacggccgtgataattaagataaagagaaacgttaccgttgaaaaatccgcagtgaccgctttatggttaaagttttaccgatctatacagggcaagtggctaatacttgccgagttgtggctcctgtttgacagtctacaccgcccacatgggggcgacaatccgtccctataacaagtgcggttaattgcggcattttaggctttaacgggctgcgcttcgtgctccaacaagctttgtaaacctgctgacttattatcgatctcttgccactcttgttccgcatcagaaccggccacgatccccgccccggcatacaggtgaatctgctgcccatcgactcgcgctgaacgcagggccacactgaattcagtgcgtttaagtgacaaataaccggcagaacccgcataccaaccacgggaaaatagctcatgtttggcaataaactgccgcgccgcctcacggggcaaccccgccaccgccgcagtcggctgcaagcgttgcaggcagtcagtatcactggcccggctgagttgcgcacagatacggcggcgcaaatgctgtactttgcgcaagcggataatttctggcggcatgacatccacggcggttaccccaccttgcaagcgctgacaaatatcgtctaccaccaataaattctcgcgctgattcttttcatcatgcatcaaccaatcggccaataccgccgcctgtgggtcgctatcaagattagagacggtccccgccaatgcttcggtttctaaatgtaattgctggcgtagatagagccgttcgggactggaacccagaaaggcctgtcgatcatcaaaacgtaacataaagtgataacaacggtgattgacctgtcggctagcagacataaatgcagcgcacgaaagcggtttattcagcgtcaacgtcgtggtccgtgccagtaccactttgtcgagcttttgctgctcaatatcatttagcgcttgctgtatcagattgcgccattgtggatatcccggtgtatgactcgaatgctggatacgcgcattcaacacaggtagagcgcgggctgccatcaattggtcaataaacgtgatggcctgtaaggcatctttctgtagggaggtctcgctgctcaaattaagggtgagcgaggtttttttaccccggcgtaatatttcaagacgcggtagaaaaagaaagctggcttgggcgttttttccactgaccaggccattatctgttagttgcccgaataccatcaccggttcaaatgcattgaggccccaaatacgcagcccattagcatcagggttttgctgaataaaatcatcggcatctttcatatcggcaaatgagcgggtttgcccgcagacggcggcttcttcatggttgtcacggtgacgccaataaaattgaggaaagtgagtctgagcagttaaccactctaacaattggcggcccaccaagccgggtgctggaaaaataagttgttgaatacctgcctgttcagggaaaccggcacataatttctgtcgtaattcacccagcaaaccagaaagttgtttcacgaccacctcggtaaatcaacagaaagagtgggattatacggggtgataataataagaaaagtcggattggaaagttattgttacttatcacactaatgtttgatattgatgatttcgcatactaaaaaagagttatcgaggttgatgaccacgcaatttatagctcagtgagtaacaggttgagcgcacctggctgtcgtcttacccattatctaccttccccattatctgccttcccaactatctgccttccccattatctaccttccaaatcatttgccttccaaatcatctggcaagcggcattcccgccgcaacgcaaatggtttgcccggcgtcaatactcattttatctttcgatactcatcttatctggagttgcaagcagtaaacgaacaacaaattagccaagaaccgtatttaggctagccggtagggtgaacctcaagcaggaggcctattagcctcgttaagtgcacgggtatccatgatccggcccaagggaaacgctgacactgctgcaactccaatgacgttgattatattaagcaggtacgacattccattgctgtgtttcatccaatgtggcgactaatgaatatatattacccgagtatttcaactcattactgttcgtcaccgtttgtgccaacacctgccccatctggaccccctgacccgcagcaataaaatagagaggttcaggcgtatagagttgagttgtattggctaagacttgctgggcaaaggtgccctgcccggacatgccaatccccgtcgaataaacattatttggcatgctgccgccttcaataatcgtcaatttacccgcttgccctgcggttgagagattgctaaaagtgggtgtgttatccgcagtatcaaacgtcacctgattatgactggtgggatcagcatccaaaatagcacccgcttcaaaaagaaccccgtcagtgagatgcccggttctcccccagacaaatgagtagttaatcgaccatttaaacgtaaagaaactattaggtgcgactttaaatggcgaggcttgccaagccaaagaaaagacatccgagggttgatttggcattttttgatataaaaaaacagtccaggccgaagatgaatgattaacgaacttaacttgatagggggtgccagcagcggctgatagatccaaagtattactcatgatgagttccttattacatttatgtaaagtatattattcacgctaacgatattcgcctatttcaaataaaggtgacatagagagccaagccatttctcagcctaaaacctcaatagagaaatggcttaattcattaaaaaataaaattaaaacggcaaagcacgaattttattaaagatattaatttaatgggtaattaattaaccaccataccaatgccatgcacgtaaaatcatactccgtcgctttaatatgatagagcaaaatacttaactagaatcactctcacaccaacaaataaaataaatttatgtagtggattgatgttaataagcattttaatggtatttttatttatcacatcaagctaaaactcaacacttcaaaacaaaataaataaaaataatattatgacatatgaaattaatgggttttgtaaaagtgaataaaaaatgatgagtaaggtgagtatttattatcaatacgctcattatgcttacgataaaagtggcccacttaagggccagtaaccacaacgtaagcaagagaacgggttagcgacgagccaccaatagcccaacaatcagtccaatagtcgcgccaatacccacgctacaccatgggttctgacgaacataatcatcagtacaacatgccatggcttttatctgcttgatatgacatccaccgtggtcactcaagcggctttgaacctcctttagtgctttctctgcacgcgctttaatttcttgatagctttcatcagccaacgttccggaatagcgcagtacctcttccagggtatcggtcaacatagccaggtcatcctctaacgaggttggtggttcattatctcggttcatgtgcattctccatgcgtgaaaaaggcatcttataccctaaataattcgagttgcaggaaggcagcaagggagataatcccgatgagcttactgttcgtaagtgattcgggttattgagtgcagccaacgcatacgcagcttgaagtatgacgggtatataaggatagtcgaattaataacagtatgttgacgctgacagcaaggattgcattaaaaaacccttatcgcgacggctgggggattaacaccaaattatgtaatgttatctttactgtgtctcagtatctcttttattttaaatcaatattattttctgcaacctaccgggtaaaaaaagcaatactcggttaatcatagataaactacactgtgcttatttagtgtagtgcgtacaacttaatcgccctacccaagattttaatgacataccgaataaataaatttacgtactagagcaagaggttaaaaacatccagttactgactcactaataataacgctcattaaccttatgactgtcaaatattattgagttacaaaaataacgcttataaaaaggcaagaaaaatgaaaaacgaattggcgatggctttcggtgggatgatagtcggtataagtttagcgatattgattttatgtattatctttggtttaacatctcctgaaacggttattagctatgccgactgtgttatcaaatccagaaattaaatcattttcttgaataataatatacccatcaggcttcaagctgcctgtgtgctggttgccttcgtgactcggcccgtccatggaccccgcctcttcgaggccactgcaagtcacgtacaaatctgcgtttttatttattgacttgaaactcattcatatattgaaatcctgcgcggaaatggcgcacagtgctctgaataaaaccacctaaatagcatttagaaacgaatacaacacgccccctgctctgcaccagaaagctgttcacgtaatgccccaaacaactcacggccacatcccacatggaaagcagagatagccggtaacggactatcgcgagtggccaattcagcctcatccaccagtaatgacagctcgccactgaccccatcgacccgaatccggtcaccattgcggacgttggccagtaaaccaccgcaataggcttctggcgtcacgtgaatggcagacggcaccttgcctgatgcgccggataatcggccatccgtcaccaacgccaccttaaagccacgatcaagtaatactcctagcggcggcatcagcttatgtaactccggcataccaatggcctgcggcccctgatagcgcaccaccaccacacaatcgcgatccaaatcaccggattcaaaggcggcttccacatcatgctgactctcaaatacccgcgctggcccttcaataacctgatgctcccgtggcactgccgaggttttcattaccgcccgccccagattgccgtttaatactttcgtccccccctgagcagaaaaaggctgttccagactggcgatcaccgtcgcatccagtgactgttgcggcccaggacgccattgtaatttacccgccgccagataaggctcttgcgtataacgctgcaaaccaaatccagcgacggtatgcacctcttcgtgcagtaaaccgccttgcaatagcatattaaccagcagtgccacaccacccgatgcctgaaaatagttgatgtccgcggggccattagggtaaatacggcatagctgcggcaccgcttccgacagttcagagaaatcatcccaattaatgatgatgcccgccgcccgcgccatcgcgaccaaatgtaaggtgtgattagtcgaaccgccggttgccaacagcgcgacaatcccattgacgaccactttttcatccaccaattggccaacaggcaaatagctgctgttgatatggttactgctgatatggttactgttgatatggttactttcaatgtggttaacattaatatgattgccatcaatatgattgctatcaatacaattgatgccagtttcggtcagacgggtgatttgacgtgcagccgctgcagtcagcgcatcacgcagtggcgtattcggttggataaaagaggctcccggcaaatgcagccccatcacttccatcaccatctgattagaattggctgtaccgtaaaaagtacaggtcccggcactgtgatacgaagcggcttcagcctccaacaaggcttgcctatccactttcccctcagcgtaaagttggcggatccggactttctctttgttaggcaaaccgctggccataggcccggcggggacaaaaatagccggtaaatggccaaatgacagcgctgccattaacaaaccgggaacgattttatcgcacacaccgaggtagagagcaccatcaaacatattgtgtgacaggccaatagccgctgacatagcaatcacatcgcggctcattagcgacaactccatcccatcctgcccttgcgtcaccccatcacacatggcaggaaccccaccggcaacctgcccaatggccccaacctcatgcaatgcgtctttcagttgttgtgggtaatgttcataaggttgatgagcagacagcatatcgttataggacgtaatgatggcgatatcgctacgcaccctattttttagggccgctttatcctctggctgacaagccgcaaagccgtgcgccaggttaccgcaagccagttgtgaacggtgaacggtatgctcttttgctgcactgatacgttgcagatatgccgtgcgtgtggccgctgagcgcgcaatgatacgctgcgtgacacgggtgataatggggttcatctccattccttatacgctcaatggggttaatggggtcaaaagttcaatgctgccagtgggcaggccgataaagtcggccagtacctgtaacagtaaattgtggtcatccaagtgcggtgcaccggaaacattaacgctgccgataatacctgcctgtttaatttgcagcgggaaagcaccacccaatgcggcgtaatcccgcaggctcacgccatagcgagcgtcgagtgaggtctctcgctgctgtaacatcaacccggcagcataggaactggtgctgagtaactccacgacattacgtttacgccgcagccaatcttggttctcggcacaggtgcccgccatcgcatagctaaagagcgtttgatgattcacggtgatatcaatagccagtgccacgccttgtttctctgcctgtcgctttattttttcgcctagctgccaggcggtttcattatcgaaatgcctcagttgcaagcgttgttggtgctgctgacagtaggcgagttgttgctgtaaattcatcagattctccggtgataaatggcatcggcttacgcacgtttcgctttagtcaaaccgttgtcagcgatatctttccctgtagatttcacctcgacatcacactctttcggcaacgttaaggtaatcagcccagcaataatcaatgatcccgccaacatgcagaccgccgcgctctggccatagaagaagatcatcacccccaccagataggggccacagaagccccccagattgcctaaaccgttaatcaccccccgcgcaccaccagctacttctggcaccgcaatacggccaggaattgaccagaatgggctggttgccgctttcaggaagaagccacagaccaccaatgccagatatgacacaagaacgttgtgacggaaaataaccgatgccaccaacgccgcagcaaagcagaacagggaaatcataatcagcagacggcgcttaccggttttatccgccagtgcggaaataacataaataccggcggtggtagccacaaatggcaacaccgccagaataccgacggatgccatattgccgccggtcaggttttttaagatagtgggcaaccacaatgtgtaaccataatccccggtctggtagaagaagttcagcgccaccagcttcatcaaacctttattgagaaataccgcttttaacggcgcattggtcaccggcttattgaacattcgttccgctctttcccgcgacagttcagtgaccagataatcacgctctcgcgctgatagccatttggcctcctctgggcggtcactgatcacaaaccaccacatcaccaacaccagtgctgacaacccaccttcaaggaagaataaccaacgccagtcgagcgtattgatgataaaacccgacaacggtgcggtgaacatgccgccaatcggtgcaaacatcatgacgaaagcattagcgcggccaatttcgcgctctgggaaccagttgctgaccatggtcaacaccacgggcaacatacccccttcggaaacccccaagacaaaacgcaggaacagcaattgataatgatgggtaacaaaaccagtcaggatagagacgatggcccagaccgctaaagaataagcaatgaattttctgccgctgccatgtactgcaatacggccaccgggtacttgtagaaataaataaccgataaagaaaataccgccggctaaaccggccatttggctggtaatcgccaaatcactttccataccgcccggtagagcaaaactaatattgacccgatccataaaagaaataatacaagcaatcattattggcacaataacgcggaaccaacgggcattagggatcttactgtccatataaatacgcctcatgataatatatccgtcatacttcaagctgcatatacgttggctatactcaattgcccaaattatttcttggtcgttgaccttaaaataaatacacccaccttcctgaagctagaattattttgggtatagactcactggggctttctcgcttgccactctcctgcaattcgaattatttaaggtataggttgtgaataatattgggtgagaaatttaaaaaaactaaatgcgttttttattggttaaatagcaaaaaataattttcgattgacgcgtcagataaactttattttctgacgcgctattactcatggataactaaaatcactaaagagtgattgaggttattgacaaagtgcccgcgacggagagaacaggcagatcgtaaagacgccgtaaatacatccatgtaggctcgagccgcgccatccttggcgcggacgctttactcctctgcctatcctcaccgttcaagatcgcgtcatcggggtttgtcagcagtctgaatcactaaagagtgattgattctattaataggtaatcgctgtaggtgccgtttcgccagagaaatgggccaaaatatttgagaacacaatatcactcatttggatccgggtatcagtggtcgcactggcaatatgtggcagcaagaatacattgtccatttcaatcaaggcttgtggtacatgaggctcatcggcgaagacatccagaccagcaccgccaatctgttgctgttgcaacgcactgatgagatcatcctgattaaccatactgccacgggcaatgttaatcaggatcccatgattaggcatcgcggcaaaaatggctttatcaaccaaacccgcactgtcttttccaccagaaattgccaccaccagaatatcgctttgctttgccaggctaattaaatctggcacatattgataaggcagactgctgtcgtgcacggtatcagtataggcaatttgcatatcaaacccgacagcacggcgggcaatagcgcggccaatacgccccataccaaagatccccaagcgtttgcccgtcactttagacgacaaaggcaagctgccattcggccactcccctgcccggaggaactgagaggcttgatagaaacggcgggaggtggcaataatcagccccagagccgtatcagccacatcatccgtcaagacacccggcgtggtagtcacgataatattgcgctcacgggtataatccagatcaacggcatcagtcccgacaccaaatattgagatgatctgcacttcaggcaataacgccagtacctcattagtgacgccaatatcacctctggtcacgatacctttaatattcttgccctgctctgccagaaattcagcctgatccgtaacctgatagagtttatggacggtgaaagtttgttccaacttttcagtcagatagtccattaccggagcgattatcaatacggcttgtttgctgtttttcattacgagtacctgatcatgtcaataaatcaaaaagaaatcagaatagtggcagacaattatcggctgataacgccagcccatcgcggcgggcttgattacctgcccccctgcttgccattctgtcggtctctggagccattcagtgaatgtcgttatgagacctgttttccctgttttattttgtgacgtaggtcactgtagaccatgttaaaaaaacatgttaccggtaacgtgaccagcttatcattgccgaagctgaattgtttcagctacagaatagacgttaacaatctctgtcgcaccttaggggggaatgttattggttgatacgcattgttatacgttggcgtcacctgttaacaggtgataattgatgagccgatgctctacccgcgtgtactgccaatgaacagggccgtggtgatgaaaaataacaggaaaccgaatcgacttccctttagtctcagatagtcccaccgagagagagacgataatgcaggtcaacctgttcaatagtcgggatttttttgattttcttaatcaaaatttcggcggcaactttccccatttcaaaacgcggtgtggtcacactggctaatattggtgttgtcgcctgaccgatatccaacccatggaaaccggaaatcgccatttcagccggtattgccacccccagtttcagacattcttgtaacactccgacagccatatcatcattagtacaaaaaatagcatcgacatcgggatacatttgcctcgccaatgccagcatccctgcgccaatagagacggaggacactttatttggggtaatgtgcagcggtgtgaagcccgcatcagtcaccgcctggctatagccctgataacgcttacgatcacgcgcatctgacattgagccaaaataaacaatatgttgcttgccgctagccaacagcgtggtcgtcatgtcgtaagccgcttgatagttattaaaaccaacggttattcgattctcttgcggctccagatccatcacttgtgcaatcggaatctctgctgcattcaaatatttatctgcgcgtaaggtatgttcggaatctgtgaggatcaagccggatatctgacaggagagcaggttaataatctgctcctcttcccgcgctttattgtagttatagttaaccaccaacgtctgatagccattggcaacggtgattgattcaatccctgccagcagatcggagaagatttggttattaaacgaggggaccaaaataccaatacgcggacttttctgatttaggctggtttcactttcgggatccgcactgtaattcacttcagccatcacctgagcaatgcgctcaccggtttctggtgccactttttccggcatccgtaaatagcggctgactgtcattttagtcacgcccgccagtaacgcgatatcctgtaacgtaactcgctggtttttcatggcaaatacctggtactaaagtgcgaaaaaagtgggttgattatggcccaggttgatcgaaatgttaatgctattaatgcataacctcagcgcgtagatcgataaaaagggataactttacggcagttacaccgtcgggaggggatgcccgcccgtatttctcaatggcagaagcgccccttggtctgctcaatgacaggctaaaaaatgttgtccataccgctattgcctaaaaatcatgtaaaatcaggccgataaattcggcgctttgggggtacgggataagacgttgatgaatgtatggcgttgatgaatgtatggcgttgatgacggtctgacattgataaataaaaacgtcattttgcggcaaccaccgtccccgagaaagaacctgctcagagctatatcccaacggcctctgagccacaatacccgttaaaggggatcaataaattctgcatccccccgcatttaaggaataggtcatgttgttacatctgaaaggaagccaccgattcattagcctgatgctctgcgcattattactcgctggctgtggacatcagcggatgccagagaaacccgtgagtccggtagggaaagaagagccggttcgtggtgtctggctaaccaccgtgctcagacttgactggccttcactttcatcgattaacgctagctcagactcgatcaggatcagcacgcaaaagaaagaactgacagacacattagatgacttggtgaaaaacggcgtcaacacccttttctttcaagtaaagcctgatgggagcgcgctttatcattcagccattcttccctggtcggatgttttgaccggtgtaacaggtcaggatcccggttatgaccctctggcctttgcggtatctgaagcacataaacgagggcttaagatacacgcgtggctgaacccctaccgtgtctcaatggatacccggccggaaacgagtgcatcacttgagcgcacgctctcttcttcgccagccagtgtctacgcgctgcataaagattggatacgcaccgccaatggccggtttgttctcgatccggggttacccgaggtacgccactggatcaccaatattgttgccgaactggtcaaaaattatgacatcgatggcatacagtttgatgattatttctattatgaaaccccgtcatcccggcttgatgatgatgccacataccagaaatatgggcagtccttcagcgataaggccaattggcgcaggaacaatacgttgttgctcataaaacaggtctcttcaaccgtcaggtcccttaaaccagagattgagtttggtgtcagcccggcgggcgtctggagaaatcaggccgatgatcccctagggtcagagacacaggcaggcagcccttcttacgataccgcatatgccgatacccgtttatgggtgcaggacggtttactggattatatcgcaccacaactctactggacgcatagccaaaaaaaggtcaaatatgacacgctggcaacatggtgggcagataccgtcaggcatagccacaccaaattgtatatcggcgtcgcgttatacaaggttggccaaccctcgcagaccgaacctgactgggtactggaaggcggtgtgcctgagctaaagaggcaactggatctcaatgacacgctgccggaaatcagcggaacgattctgttcagggaagcgtttctccgtcagccccagacggaagaggcggtgaaatatttgaagtccaggtggcgtaacggaaatcataaaacgcagccataggcggagccatttttaaccaaaaaatttggctccccacatgcatcggtctgtaaaaacaatattgattaaaacccagtgtcgttatattacgctggcgttcctatcgagaagatgcgcatcgatgacgcgttgaatgaagaatatgttaccggctaaaaagacaataacagccacagggcttaatcttaaatcacttgattatcaacacattaatcttaaataccgtcaagaagcggagcaactccccgcagtataagatttttgcccaccagtaagtcgatgttgctcacgtatccggtaacagcctgctgtaacatgacttatagtgatctgcatcacagtttaatcagtcagaaaacggtctgataagcacatgttttcagtaagctcaatttaatggttatcgtgttaacagaataggtgtgtttataaaatcttaatattgagagattaagagtaaatcatattattgcctgactaagccttatagcttggcttattagcgataattaaaccgccttcatatttaatatgattcagactgctgacaaaccccgatgacgcgatcttgaacggtgaggataggcagaggagtaaagcgtccgcgccaaggatggcgcggctcgagcctacatggatgtatttacggcgtctttacgatctgcctgttctctccgtcgcgggcactttgtcaataacctcattatttttatatattatcgctatcaggaagtgaccatgaagaatctattttcgttggaaaatcgcaaagtattaattactggctctgcacagggtattggattcttactggcaaaagggttagctgaatttggcgcagagattatcattaacgatatcaccgcagagcgtgctgaaaaagccgtggctgaattacgtgctagcggctttatcgcccatgccgccgcatttaacgtgacgaaccatgatgaagtcaatgaagctatcgagaaaatagaaagccatattggtgctatcgacgtgttaattaataatgccggtatccaacgccgccatgcctttaccgaattcccagaaaaagattgggatgatgtgattgctgttaatcagaaatcggtatttttagtttcacaagccgttgcccgttatatgattaaacgccaacgtggaaaaattattaatatctgttcaatgcaaagtgaattaggccgcgatacgatcaccccatatgccgcctctaaaggggcagttaaaatgctgacccgtgggatgtgtgtcgaactggctcgctacaatattcaggttaacggtattgcaccgggttatttcaaaacggatatgacaaaagcactggtcgatgatcaagcctttaccgattggttgtgtaaacgcacacctgccgcccgttggggagatccagaagagctcattggtgcagcggtttatttgtcatccaaagcctctgactttgttaatggtcatttgctgtttgttgatggtggcatgctggtagccgtttaatccagggttcagtcgtactccccacataatggggagcagaggaaaattatgtctggtaaatgcattattgtcatgggtgtctctggtaccggcaaatcctgtgtcggtcaggcgctggcattggcccttggcgctaaatttattgatggcgacgatctacacccacgggccaatatccaaaaaatggccgccggccagccactgaacgatcaagatcgtgcaccctggcttgagcgattaagtgatgtggcgtatagcctgcaacaaaaaaacgaagtgggttttctggtgtgttcagcactgaaaaaacagtatcgagaccgcctgcgtgaaggtaatgaagggatacgttttctctggttgaccggtgattacgatttagtgctacaccggatgcagcagcgggccgggcattttatgccagagagcctactcaagagccagttcgccacgctggaagcgccggggagcgatgaaccggatgtgattcccatcgatatttcatcttccattgccgatgttgttgaacactgtattgccgcattgtcactggaaaaccacgtgagcgcgattcttagtgaatagcggtgctgaatgaatagcgttttttattgaatgacggtgcttaactgcgcggaccccataaggggataggaaaaataatgatacttgatgaactaaaaaaagcggtgaataaccccatctatccagaagtgatccgtcggacactggcggcaatcagccaaatggatttagcggccctccccgccggtgaacttgagattgaagggcgcgaaatctacctgaaccatatgatcgccacgacgaaaccactgtatgagcaacgccctgaattacaccgctattacattgatattcatattctcttagaaggcagtgaagtgatcggggcttcgccatcaacccaaggccaacgcccgacgatggattttgatagtgagaaagattacggtttgtttgaggggatgagtaccgagaccttgctgacgttagcaccgggtgatattgccctactgttccctggggaattgcatcgcccgatggggacattaacagacccggcccccatccgtaagctagtggtgaaggtggctaatcatcttttatgatggttggtacagatgacagatgacagatgacagatgacagatgacagatgatgattggcgttgacttgaacgaataaacgctcaaccgagagttccaagggagccatgctcccttcagacggcagataacccgcggtgacgtaatattgaacggtgagaataggcagagagtcaggcggccacgaaatttggcacctttgctgtctgtctctactctctgtctgtctctactctccgtcgtgggcaccttgccaataaccccttattggctccgtctcgccgtcagacacaacccgctattcttcattaacacaacttaagtcaccgatcatactgttcggggcagatacgtaccatgacgccgatgttctattgctgctgagatatggccgctgcgcgtgagttgttccgtaaactcaacttcagccaaagaaggtattttcagcgcatacttttcacgggcaaattcataataatctttgcagcaccggagaatatcatccgcagagatgttttcattgatctcccgtaaatgttgctcgactcgctgataaagttcactcttgcggatatcgaaggtcttatccaataagaataatcggctaaatttattatttcggggtaaattagcagcgagataatgtttatatttctgattgtgaccaataggcgtgtctttttcaatccaggttcgggccagcgcatttaaataagcatgacgatggtattcctcataattagcagccatgagaagcggatcaataatagttttagatataatgcgatatgcagcgctatccgtcattaaactattgttaaccatgctatcttgcagttcttttatcacccgattaataatctgctcattcggtagcttttcttttccactgtttagctgataatagtcgtcagcaagtttatttatcgtactgtccaagactctcctaggtgattctcctggctgaacataaaggttcttagtatgaaactcctgaaacaacacttgcctaatagggtctgaaccatagcgctgcttggccccccctgttttgttggtcgtcaatcccaacagataggaaaccatcgacaggacatcctcacatttttcttgcttgttttttatcgcctcggctctcactgccccattctgtgaaatcaattggctctggaccgttgagtttatgacttcatttactgatttcagcatttttctgatagcgaactgacaaagagactctcgccgataatcgtcaagtcggtattctggctgattatttattttatgcgaaaccggagaatacagattactccaagcttgctcgacaatatgtgaacataatgcaacgctgctttgtgacttttccaaaaaataagctgtgaaatcatcatttttataaaaatcacgttgtactctttgctgagaggataaattctcatgtttccccgtatattgacaaaaacttttgtcaagattttcaaccaaccgatcgatatagtttctatcggcccttgatgggtataaaacattaccatctgatgccaattctgaggaaaatggaatagtgctgttatagtttgtcgctgatatgttgggcataactatcatccttgatatccgaatatatcggataagattacgtggctaacaggtagctacatattctaactatcaagcctactgacagatatccatggttaaccccaatctggtttaaatcacctttattcagcggttactcctgagccccagataaaacaaaaccccctgtaagccgatactcacagggggtagggtctatctcgacatcattcgtctgtgccggtttaacacatcatcacatcaagggctgagccatctgcaccagtgttatcaacggttgcggatagatacccaacaccagtaccaaaatcgcggagatcagtaccaccacaccaccggccgttaatgcccagttgctcggggtatcacgtactaagctctgcggcgggctgaggaacaaactgacggtaacgcgcagataatagtacaagccgatggcactgcctaacaccaccgcgccagtcaaccaccacaagttggcgctgacccccattgccaccacaaagaatttaccgataaagcccagtgtcattgggataccggccagtgacaacatcatcactgtcatcaccgcagacagaataggcttatgccagaacaagccacggtaagagaacagcgattctgcatctgggcctttgtacgggctggacatcaggctaacgacgccaaatgcccccaggctactgaacagataccctgccagatataccccgatggtttccagcggtaatgcgagctcgtgtgtttgtactgcgaccaatgcaatcagcaaataaccaaggtgggcaatagaggagtaacccaacaggcgtttgatgttggtctggctgatcgccatcaggttgccaaacaggatcgaggccaccgcaataatcgacaggaccaaacgcacggcttcgctatccgccgccggtgcgtacataaacaagcgcatcactacggcaaagatagcaatcttgctggcggtcgccaggaacgtggaaactggcgcaggtgcgccctgatacacatcgggtgtccacagttggaacggtactaacgacagtttaaagccgaggccaacaatcatcatgcccagacccgccagaatcagcggttggtgcaccatcgagtcacttaggctctggcccaaccctacgaaggacaggctaccggactcagcatacaacagcgccataccgaacagcaggaatgacgatgccgccgccgacaacagcatgtatttgatactggcttccagtgaacgcttctggcgataggcataaccaatcagaccaaacagcggcagagtaagcagttcaatacccaagaacagcgacgccagatgattggcactggcgagcagaataccgcccaaagccgcaatcagcaccagcagatagaactcttcgcggttatccgggtagccgaccaaccaagggtaagcaaacgtactggtcgccaagctggcgataatcaccagcccggtgtagaacatcgaatagccgtcaacccgcatcagcggcgtaacatccatcggcccgacctgtccaacaaagtaaagtgacagcagcgccagattaagcccaatgacggtcagtgtggcattaataaagtgatcgcgtcgccacgcaatggacagcatcacaaccaccaccgtcaatccgacgatcaacagcggtagcattgcgatcagttgttgaggagttattgtcatggcgaattatggccttgtaatagatggagctggaatagatgcagctgaaaaccactgttgcacattactcattgccgcatgggacgtgtcgaggatcggctgcgggtaaacccccagcaacacaagcaacaccaccagcagcaagacgatggacagttctcgcgcggtcatacccggtaaggcttcctccgattttggcgtaccgtaataagcacgctgcatcataataagcgagtaaaccgacgcaaataccaagccaaaggtcgcgatcaccgtaatcaccgaaacgacctggaaactaccgaataggatcatgaattcgccgacgaagttaccggtccccggcatccccaatgtcgcgacagcgaagaacagggagagcgcaggcaggtattttatccgcccccacaaaccgcccatctggcgcatatcacgcgtatgcaaacgttcgtacaactgaccacagataatgaacatccccgcggctgataaaccgtgagcaatcatctgaattaccgcgccctgataagccagttggctgccggtatagatggcaatcaatacgaagcccatgtgcgacacgctggtgtaagcaataagacgtttgatatctgtttggcaaaacgccatccatgcaccgtagaagatgccgataacccctaaccacatagcgataggggcaaactcatgagacgcattcgggaacagaggcaggctgaaacgcagcaaaccataagcggcggtcttcagcaaaatccccgcaaggtcaacagagccggcggtaggtgcctggctgtgtgcatccggcaaccagccatgtaacggcaccactggcatttttaccgcaaaggcaataaagaagcccagcatcagcagatattctacattccgcgacatcggagtgttcaacagatcttcgtagttgaatgtccaaataccggtggcattgaagtgcacaaataccagccccagaatggcaatcaacataatcaagccgctggcctgcgtataaataaagaacttggtcgccgcggtgatccgggttttaccgtctgaggctttatggccccacaaggcaatcaggaagtacatgggtaccaacatcatttcccagaagaagaagaacaggaacatgtcgatagccaagaacacgccgatcaccccccccagaatccataacagattcaggtggaagaaaccctgatagcgctgaatttcacgccatgaacagaggatcgccagtacaccaagtaggccggttagcaccaccataagcaaggacaaaccgtccaacgctaaatggaatctaatgccgaaacgtgggatccacggcacattataatatgtctgccactgcggaatacccgtcgggttcatcagtgaatagttgccctgcccccacagatacagggaaagcaccaatgtcagccccatcgcgattaacgcaatccaacgcggtactttggtaccgaagcgttcaagctgccagcacagcagaccgccgataaaggggataagaattagccaaggtaatagcatggcgttttgtgtccctaattaatgagcctattcaggcatctacacgaaaagcaacagagccagcacaatcactgcacccaaacctatagaggcggcgtaccaacgcacctgcccattctcactgacggtcagaccgcgattactccagcgcgaaagcaccgccggtgtattcatcagtgaattcagcggatcacgttgcaacagttttgcaacccacagatacgggcggacaaacaggttatggtacaaccagtcgaagccccacgcatggaaccaccagaccgtaaagaagcggcccggcgcactttgcgcaatgctgttaaccaattggcgtttgcccagatacaagaacgcggccagtgcaataccgatcaccaccaagacaccggagaaaatttccagcggcattttaccctcttcaccaaagtgaagctcgggcaacacacccgccagtggtggtgttatcaacgcaccgacaaaagtcgacagcaccagtaacacgattaacggcaggctatgggtgatccctttaaccggatgtgctttagtttttggctcaccatggaacacaatgaaaatcatccggaaagtatacagcgcagtgaggaatgccccgaccagccctgctaccatcagattgatatggccactggccaatgcgccccacagaatttcgtctttgctatagaagcctgcagtgacgattggcaaggctgccaatgctgcaccacccaccaggaagcagatatagaccaatggaatggtcttacgcagaccgcccattttgaagatattttgctcgtggtggcaggccagaataactgagcctgaggaaaggaacagtaacgctttaaagaaggcatgggtcatcaaatggaagattgccgcatcccacgcctgtacgcccagcgccagaaacatgtagccaatctggctcatggtggagtacgccaacacccgcttgatgtcggtttgcaccagtgcggcaaagcccgccaacaccagtgtgaccgcaccgataacccccactaaatgcagtacttcaggggccatcaggaacaggccatgagtacgggcaatcaaatagacaccggcggtcaccatggtcgccgcatggatcagcgcggaaaccggcgtcgggccggccatcgcatcagccaaccaggtttgtagcggcaactgagctgatttaccgaccgccccccccaagagcattagcgtcgcccaggtaatggcggtcgagcccatctccagtttctgcggtgccaaaatcatcagttcgcggatgttcagcgtgcccaactcttggtaaagaatgaacagcgcaaaagccaggaatacgtcacccacacgggtcacgataaaggctttcatcgccgccgcaccgttggcagaatgcttgtagtagaaaccgatcagcagataactgcacagccccacgccttcccagccgagatacatcagcagcaggttatccgccagaaccagaaccaccatgctcgcgataaacaggttggtataggcgaagaagcgagagtagccctcttccccacgcatataccacgaggcatacatgtggatcaggaagccgacaccggtcaccaccgacaacatggtcagcgacaaaccgtccaatgtcagggtcagcggaatgttaaaggtgccaacagacatccagttccacagcgtctgattaaacacctgtacgccagtggctttttggctgaggaaatccaccgccacatacaacgtcaccagcgcagtcagcccgatagaccccaccccaacggtagccgcggtattttcagaccagcgcccacgggagaatgccaacagcaagaagcccagcagtggcagcagaattgttaaatataataggttcatccgcgcatctcactgactgtatcgatatccagagtatggcggcgacgatacaactgcagcagcagtgccaggccaatactggcctcggctgccgccagcgtgatcgccaggatatacatcacctgaccgtctgcctgcccccagtaactgcccgccacaacaaaagcgagtgcggctgcgttgatcatcacttcaaggcttatcagcataaacagtaaattgcgacgaatcagcaaccccgttagccccagcacaaacagaatggccgccagaatcaggccatgttgtagagggatcatgcttgttcctccgtttttcttttcgctgaatcactcgcacccatcacgtcacccggcttatgttcacgcccgatatggaacgccaccactaaaccggccaacaacaacattgacgccagctcaaccgccaacacataagggccaaataagctgatcccaacggctttggcatccaccatttcaccgctgataccctgatcagagacagagctaatggcatagatcagtactgatagcagaaccagagcgagtaaaccggggcctatccacatactgggtttcagccaggcacgctcttgttgctcgacgttgcccaggttcagcatcatcaccacaaacacgaacagcaccataatggcacccgcgtaaacgatgatttccagcgcaccggcaaaataagcccccaacgagaagaacaccgccgaaatagccaacaaagagataatcaggtacagcaacgcatgtaccgggttggtgtgagtgataacgcggatcgtcgccaccacggccaccaatgctgcaatataaaacgcaaattccatggaaaacggctcctagggcatcagacctttaacgtcgatcggtttggcttcattttcggcttcgcctttctgcttgccatcaatcgccataccggccatccggtaaaagttatattccggatatttacccggacccgagatcaacagatcttctttctcatacaccaggtcttggcgcttaaactcacccatttcgaaatccggcgttagctggatagcggttgttggacaagcttcttcacacagaccacagaaaatgcagcgggagaagttgatacggaagaactccggataccagcggccatctttctgttctgctttctgtaatgagatacagccaaccgggcaggcaaccgcacacaggttacaggcgacacaacgctcttcgccgtctggatcgcgcgtcagcacgatacgaccacggtaacgcggcggcaggtaaaccggttcttctggatacattaaggtttcgcgcttgtggaaggcatgaaggccaatcatccacaggctgcgcacttgggtgccgaaaccaaccactaactctttcaacgtcatggtttattcaccccttattgagcgttgtacaaaatgaccgcggcagtcgccagcagattcagcagggtcaacggcaggcacactttccagccgaaggacatcacttggtcataacgtgggcgcggcaaagatgcacggattagaatgaacatcaccatgaagaaagccgttttcagcgcaaaccagataaatggcggcaggaacgggccttgccaaccaccaaagaacaaggtgacgatcaacgcagagacggtcacgataccgatgtattcacctacgaagaacaaaccgaatttcataccggaatattcaatgtggtaaccatcggccaactcttgttcagcttctggctggtcaaagggatgacggtgacaaacggcaacacccgcgatagcaaaggtcaagaaaccaaagaattgcgggatcacattccagacgtgctcctgagagttaacaatatcctgcatgttaaacgagccagcctgtgctaccacgcccatcagcgataagccgaggaacacttcgtagctcagggtctgtgccgatgcacgcatcgcccctaacagagaatatttattattactggcccaaccggcgaacagcacggcatataccgccaggcccgccatcatcaggaagaacaaaataccgatattgaggtccgctaccgcccaagtcgggctgaccgggacaatagcgaaagacagcagcagtgaggtaaaagcaatcaccggtgccagggtaaaaatagcccgatcggagaagcgagggacccagtcttctttgaagaacatcttgatcatgtcagcaaccaactgcaatgacccgccccaacccacacggtttggcccgtagcggttttggaacaggcccagcagacggcgctcaccaaagctcataaatgcgccacaggtcactaccaccagcaaaatcacgaccgctttcaggacagagattaaaatctcaatcaattcaggcgtaaaccagctcattgtactgcctcccgcagatcctcaacccgcgcacccaccagaattggtggaatacccggtaagccaagcggcaagccgacctgacctggagccaaggtgtcactcaagcgcacaggcagacgcagggtctgacccgcacagttgaactcaaccagcgtaccgaggttaaccccgagcgccgcagcatctgccgggttgaccatcacataaggtgttggcatccgttgctggataacatctgaacgctgtgacatctcttcgctaccaaacaaatggtaataaggcgcaatctgccaattgcccgccgtagcggtaaaggcagccggtatggaatcgaagtaatccaacgttccctcccctgcttcaatcagccggacacctggatcaccaaagcgcaggttcccccccacttccgcctggaatttgttccacgcctgtggtgagttccagccgggtgcccaagcgaatgggatctgctgacgatcggccaatgggctgttattcccttccattgagaaggagaatggcgtgtcgatgtcctgtggttgacgcggttcatgcacactgatatttgcacgcatcgcggtacggccactgtagcggtgtggtgaacgtgccagccgctgaccacggatacggaatgtcgcatccggtgccgcttcaacgataccttgcaactgtggcaatgcttccacacaggccgcaatcacatgatccagttgcgtccagtccacatggcggctggtataggttgagtgcaaggagtgcaaccaacgccagctttccagcatgatactgcggctttccggctttttcggatcgtcataataagtggggtcataaacctggaagaagcgctgtgcgcggccttcctgattgaccagcgtcccgtcgctttcagcaaaactggcggccgaaaggatcaagttggctttatccatgattgccgtgcgttggtgatccaccacaatcaggttagcaacgttgtccaacgccgcatcgactttatctttcgctgcatggcgatacagatcgttttccatcacgatggcactgtctgcctcaccgcgggttaacaactccagcgcctgatccagtgaaccgccgccaatcatcgataatccgatgctgttggccgcactggccacaaaggtgataccgacatcagaaccgcggtttttcagggctttcgccacgttcgccgccgcctcaatgatggcatcgctgcccgcactgctgccagtgataatcagtggtttcttcgcccctgccaaggcctgtacgataatatcgactttgcctttcagactgcgatcgaggtctgcgactgcgggtgcggactcatccagcgcatgcgcaatggcgaaacctaaacgggcttggtcatcaactggcgcacggtagttccaggccgcaatatcatccatccgagtgttatcaacgttcgtgataaacagtggatgtttggcatgctgaccaatgttcatgatcgcggcaatctgccagtcagccactttctgtgcagcggccatctcgcgggctttgcctttcaccgcctgacgaacagagagggcaatacgtgcaccggtttgcgtgaggtcttcacccaagatcaacaccgcatcgtagctttcaatttcacgcagcgctggcgtataaataccgccttcgcgcagcactttcagcatcagttgcaggcgttgttgttcaccggcggcgatgccggtatagaagttttccgcaccgaccagttctcgcaacgcaaagttgctttccaaactggcacgtggagaaccaataccaatggtttttttcgcctgacgcagaatatctgccgcaccttgcatcgcctgatcggcattcaggtggatccagtcactgccacgcaattgctgtggctgacgtggacggtctttcaggttgacataaccataaccaaaacggccacggtcacacataaagtagtggtttaccgagccgttatagcggttttcgatacgacgcaattcaccatagcgttcgcctgggctggtgttacagccgacgctgcactgctggcagatgctcggggcgaactgcatatcccatttacggttataacgttcggaatgggttttgtcggtaaatacgccagtcggacacacttcaaccaggttaccggagaactcgctttccagcgtgccgctttccgtacgcccaaagtaaacgttgtcatgagcaccgtagacacctaaatccgtgccatcagcgtaatctttgtagtaacgcacacagcgatagcaggcaatacagcggttcatttcatgggagatgaacgggccgagatcctgattctgatgagtccgtttagtgaagcgataacggcggaagctgtgaccggtcatcacggtcatatcttgcagatgacagttacccccttcttcacagaccgggcaatcgtgcgggtggttagtcattaaccattcaaccacactctcacggaacgctttggcttcactgtcatcaatggaaataaaggttccatcggtggccggtgtcatacaggacataaccaaacgcccacgggtatcatccgcgttttggtattgctttaccgcgcattgacggcaagcgccgacgcttcccagcgccggatgccagcaaaagtaaggaatatcgagtccaagggagagacaagcttgtaacaggttgtcggccccatttacgtcgtattctttgccgtctacatgaatcgtagccatatcagcatgcttccaaatgacccaccttacggcaggcgttaatcaaaaattctgacccctacggcaacaccgtaagggtatctatgctaccagcgcgcttttaatagattaggttgaataccggctatggctcgggtgttgccgctcgtcattccagattcataggccttaacggcgatcccggcttcgaattcgtcccggaaatatttaatcgcactttgtaggggttcaaccgcacctggcgcatgagcacagaaggttttacccggccctaagaagcggcacagttgctctagcgtttcgatatcacccggctggccttcaccacgctctaatgcacgtaagatcttcacactccatggcaaaccatcgcgacacggtgtacaccagccacaagactcacgggagaagaactcttccagattgcgcaccaaagacaccatgccgatttcgtgatctaccgccatcgccaacgcggtgcctaaccggctacctgctttagcaatattctcaaaatccatcggtaaatccagatggtcagcggtcaggaaatcggtacccgccccgcccggctgccaggctttaaatttcaagccatcgcgcataccgccagcgtaatcttccagaatctcacgggcggtgatcccaaacggcaattcccacagacccggatttttcacccgacccgagaagcccatcagtttggttccggcatcgttactcttaccggcggtgatcccctgataccactcaacgccatgttcaataatggccggtacgttacacagggtttcaacgttattcacgcaagtcggtttgccccagacaccggaagaggcggggaacggcggcttagaacgcgggttagcacggcggccttccagtgagttaatcagcgccgtttcttcaccacagatataacgacccgcaccggtatggacaatcagttcgaaatcaaaaccactgcccatgatgtttttgcccagcaagccggcttcggtggcctcagcaatcgcccgacgtaaatgcactgccgcttcaatatattcgccacgcaggaagatatagccacggtaggctttcagcgcgaaggcactgatcagcatcccctccaccagcagatgaggcaattgctccatcagcagacggtctttataggtgcctggctccatctcatcagcgttacacagcagatagcggatgttcatactgtcgtctttgggcatcaggctccacttcaaaccggtggagaaacctgcgccgccacgccctttcaggccagcgtctttgacaacgttaacaacatcagtgggcaccatgccttttaacgctttttctgccccggcatagccgtttttgctgcgatactcatccagccacacgggctgtttgtcatcgcgcaaacgccaggtcagcgggtgcatttctggcgtccggataatttccttggtcgttcctgaattgatggtcatggatattgctccagtaacttctcgatctcttcaggcttcaggtagctgtgggtgtcgtcatcgatcatcatcgtcggcccacggtcgcagttacccagacaacaggttggcagcaaggtgaaacggccatcgaaggtcgtttggcctggcttgatactgagttttttctccagtgccgcctgaatcccctgatagccggtgatatggcacaccacgctgtcacagtagcggatcacatgacgccctaccggttggcggaagatttggctgtagaaggtggcgaccccctcaacatcactggccgggatacccagcacatcagcaatcgcgtggatcgcaccatccggcacccagccacgttgcttctgcacaattttcagtgcttcaatcgacgctgcacgggcatcttcgtaatggtgtttctcatgctcgatagcatcacgttcttcggtactcaattcgaaggcgtctggcatggccgctggttcagccgcattgactgccagattcaccacatcaaggcttccgttatgagcctgagtctctttttgatcactcataattagcggtccacatcagacattacaaaatcgatactgcccagatagacgatcaggtcagataccaaactgccacggataaccgatgggatctgctgcaaatgggcatagcttggggtccgtatccgggtgcggtaactcatggtgctgccgtcactggtcaggtaatagctgttaatccctttggttgcttcaatcatctggaaagattcgttcgctggcatcactggcccccatgacacttgcaggaagtgagtgattagcgtttcgatatgttgaagcgtgcgctctttcggtggtggtgtcgtcaggggatgatcagccttgaatggcccttctggcatgtttttataacattgctccagaatacgcaggctttgacgtaactcttccactttcagcatcacgcggtcatagcaatcgccgttgttaccgacaggtacttcaaaatcgaagttctcataaccggaatacggacgccatttgcgcacgtcaaattcaaccccggtagcacgcaagcccgcaccggtgacgccccactctaacgcctctttcgcattatacgcggccacaccaacggagcgccctttcaggatgctgttctgcaaagcggctttaacgtaggaatccagacgttttggcatccagtcaaggaagtcgcgtagcaaacgttcccagccgcgtggcaggtcgtgcgccacaccaccaatgcggaaccaggccgggtgcatacggaaccctgtaattgcctcgatcacgtcgtacactttctgacggtcagtaaaggcaaagaacacgggcgtcatggcaccgacgtcttgaataaaggtactgatatacagtaagtgactgttgattcggaataattctgacagcatgacccggatggtgttcacgcgatcgggcaccacgatgcccgccagtttttcaaccgccaacacgtaaggcatttcgtttacacaaccgcccaagtattcgatacggtcggtgtaaggaatgtagctgtgccaggactggcgctcgcccatcttctccgcaccacggtggtggtaacccacatccggtacgcagtcgataatttcttcaccatcaagctgcaacacgatacggaaagcaccgtgtgaagaggggtggttcgggccgaggttaaggaacatgaagtcctcgttttcagtcccgcgtttcatgccccaatcttctggcttaaaggtcagggattccatttccagatcttctttctgcttcgtcagcacatagggatcgaactcggtcgcccgggcggggtaatctttacgcagcggatgaccttcccaactctgcggcatcatgatacgcgtcagatgcgggtgaccatcaaaggtaataccgaacatctcccatgtttcccgctcataccagttggcattgggaaaaattttggttgctgtggacacatgtaagtctttttcagacagtgccactttcagcataatgtcgcggttacgttcaatggaaagcagatgatagaaaacagaaaagtccgcatcagggaggccctggcggtgggtacgtagacgctcatccacgccatgcaaatcgaacagcatgacataaggctttggttgttttctcagaaacgacattacttccagcagttgttcacgcttcacccataccacgggcataccggtacgggttgcttgcacaacaaaggcctcaggcccaaaacggttcgacaattcaccaatcaccggatcatcgagatgatcacgggtttgccatgcaggctgtaagctgtcggacgtcgttaaatcagtcattatttattcaccacactgttttttcaccacactgaatgtgtcattttgtggtcatttgctgcatatatgccccagaagaaaattacgttctctccaaaaacacatcacttacgcaccgggatctaccgcccaaaaaacgggtttaaatctcgtcaggtgtacgcaggttagttaccgcaattcgttcagcatgcttacgttctctttctggctgcatattggcacggtagacaccttggtcaccgacaacccaagagagaggacggcgctctttaccaatggattcctgcaaaagcaatagcgcttgcatatacgcttccgggcgcggtggacagccaggaatatagacatctactggtaggaatttatccacaccttgcacaacggagtagatatcatacatgccaccagaattcgcgcaggcccccatggaaataacccattttggttccagcatttgttcatataaacgctgaataaccggggccattttggtaaagcaggttccggccaccaccataaaatcggcctgacgtggggatgcacgcaagacttcagcaccgaaacgggcgacgtcatgtaccgccgtgaacgaagtcaccatctcgacataacaacaagaaaggccaaagttataaggccaaagagagtttttacgcccccagttcaccatgtcatgcatggcgttttcaagtttacccatgtaaacactacggtggacatgttgctcgagaggatcgccgctgacggtttcctgagtttgcagggggtaacggtcattctcaccgttagggtctatgcgggtgagcgtatagtccatgttaatgcctcgctatatttattgaccactataccttttgcacttggcgctgctgggttgttagctaggttcactgacccgaatcactgactgatgtcagcttatcgggattcgttcgcttgctggctacctgcaacgctaagctcttgggatatatcttgcggatgactgctggcgtatctcacggtactgggtttgctcacacggcgattagaacgtgtaggagtccaatccagggcaccaatgcgcaccagataaaacaaaccagccaagagcaccaaaatgaaaatggctgcttcgataaagcctatccagccactctcacgaatggagattgaccaggcataaaggtagagggcttcaacatcgaaaataacgaaaaacatcgcaaccagataaaacttggcggacaggcgcatacgcgcagagcctactgaatctatacctgattcataaggcacgtttttggcacgagcctgggctctccccccgaggaagtacgcacctaaaagcatcaaaccgcacagcccaacagcgccgatgaggaatacagcgaacgcccagtgatgagcgataatttcagtggttgttgacatacgcattgcttactcatcaaaagtggcgtcggacatcctgctcttgtgttggcagttagtgcaccacatcgattcaaagggaaggattaaaaaccacacttaacacactgtctttacaactgcttagccagtgttttactgtgggctttttactcctttcgataaccttttgtcaactttgacaaaagtaactacacattaatttacaaacatgctgttttgcttaacatttggtgcgccctgacgagctaaatcgagtcagtcatttgttcagcaagaacatacacatagaaactcgcgtagatagatcgctttaactataccattgtctcaggaatatcctgttcttccactcagtagtggacagtatttttttgatccaggacacgttttgagtgttatttcataaatattcagcattaaaacttccattttcatgacaataattaatgaaacgttgttttaataaaatgcgaaggaatttattaatggaaaaataacccgttggtattatatggtttatttcctgcaggatcaccgatactggtcggggtaaattaagtaaaacggcacgttgaatataaaattaagctgaaatgaaaaaaaagaggatttactaaaataaataaaaaaaaccccttaaaatacaggggcttgtgatgatgaattaaaaacagattacttaatcttcatcacctgtcaaataatcggaatccaatattaatgaagattctgacgacatggtgtgctgataactgttttgtaaggcactgaaaatagcaagtgccagttcattgtcacactgtttgtctttacataagacataccgtgtttcaggtaaaccaggcaacccttcagtttcgcccaacactcttaaatctgggctcatcatctctataggtctggcggtcaccccaagccctgctcttactgccgctcgaatggcagaaagtgaagaggccacgtaggcaatacgccatggaacacccgcctgagtcaagtgctcaatagccatctctcggtacagactgggctcatccatcaccaccaaaggtactggctctccgggctggaactgataatccacagaacaataccaaagcgtgggcgatgttctcaagatgacatggggatggctatcaaccttagcggttgtgatagccaaatccacctcaccagagctcaacatatcagcgataaatgggctgcgctttacccgcacatctatcgccagccgagggtatagtgttgccactcggttcagcaagaaaggcagtaacgtatcggcagtatcatcagatgcgccgataataagtgacccttccatattgctgtacatgagtgatgtacaagcctcatcattaaaacgtaagatttttctggcatagccaagtagctggagaccatgttcagtgagtaatttgttacgcccgtggcgggcaaataactccttaccgactaactgttctaaccgttgcatttgttggctaactgctgactgagttcggcagaccgcagcagcagcagcagcaaaagtatttaagtcagcaacagctacaaaggttctaagcagatcgaggtcgagattaattatcggacgatttgcatttgtcatagtgtattcttcactttttttgaattctaattacaaactaccctggtgttttaagtatcagcgttatcaataaaggacaacgctaagtatgacagtaccccagtcattggagtagggcaaaaaaattacttatatttcgttaccgttatctcttttaaaaaaaaaaccatcggctaccgccatgtatataaatgtaaatgattttatagaaattcactaaatcttcgataaatgaaggttttttcgttattagccctaccgtttgatggtttataaaacctgaatatccctgttttaattaaataaacactatggttcagtgattaaacatcaaaaaatatcaatatatttaagcctgggttttttatctaacccaacagattcaagtaataacatttgataagcatcatgatttaaagaacttaacattagttattcttaatagttttcctatttacaggattttcccatcctaacgcagccaatatgtatgatgatataaacgaaaaagaatggatgagtacgattaaagatacgatgcggtttaatgccattcgattctatacaaaaaactttcctcataagaaactcaacggctgctgaatgttctctttttaagacctgtatatagccaacatcaaccacagaaagtgtatgatcaatgagtaaatcaaacataatcgagaatgaatagggataaaaacacggatggatctagcccacattttctatcggtaatcatttacatgaaactgatgtatagaacttcaaaaatcagtggcgtcggagtacattgagcaccttgcagtgttccacgctgaggacacgcttttaccagcaaaaggctcattttttatgtcccccattgagaaatccagcaaactggacaacgtctgttatgacattcgtggaccggtgctaaaagaagctaagcgtcttgaagaggaaggtaacaaggttctgaaactgaacatcggcaaccctgccccgtttggtttcgatgcacccgacgagattctggtggatgtaatccgtaatttaccgaccgcacaaggctattgcgactccaaaggcttgttttcggcacgtaaagccattatgcaacactatcaagcccgcgatatccgtgatctgacggtcgaggatatctacattggaaacggtgtttccgagttgatcgttcaatctatgcaagcattactgaatttgggtgatgaaatgctggtgcccgcaccggattacccgctgtggacagcagctgtgtcgctctcaagtggtaaagcggttcattatatgtgtgatgaagaatcaggctggttccctgatttggatgatattcgcagcaaaatcactccgcgtacccgtgggattgtgattatcaacccgaataacccaaccggtgcggtatacagcaaagagctgctgttagaaattgttgaaatcgctcgccagaatgacctgattattttcgctgatgagatctacgataagattttgtatgacgatgctcagcaccattcgatcgccgcattagcccctgatttgctgaccgttacgttcaatgggctgtctaaaacttaccgtgttgcgggtttccgccagggttggatggtgttgaacgggccgaaaaagcacgctaaagggtatattgaaggcttggaaatgctggcatcgatgcgtttgtgcgccaacgtgccaatgcagcatgcgattcaaaccgccttgggcggctatcagagcattagtgagtttatccaacctggtggccgtttgtacgagcagcgtgatcgggcctgggagcttatcaaccaaatccccggtgtttcctgtgtgaaacctcagggcgcgttgtatatgttcccacgcattgatcagaaacgttttaacctgaaagacgatcagaaattggtattggatctgttgttgcaagagaaagtgctattggtgcaaggtagcgcctttaactggccgtacccggaccatgtgcggatcgtcacgttgccacgggtggatgagctagagatggcggtgaggaagctggggcggttcttagagacgtatcatcagtaattgtatgattgggggatgagggctgttgatgaatcactaaatcatcatcaactggagcctgatcccccgaacaagtcaattaatgtcaaccgaaacccaatccgatatgatagccgctgattcaccgacagaaagaaaagagaataaattatgagtcacttcttcgctcatctttcccgcctgaaactcatcaaccgctggccgctgatgcgtaacgttcgcactgaaaatgtgtcagaacacagcttgcaggtcgcgtttgtcgctcatgcattagccatcattaagaaccgtaaatttaatggtaatcttaatgccgaacgtatcgccctactggcgatgtatcacgatgccagcgaagtgattaccggggatttgccaacccctatcaaataccataatcccaaaattgcacatgaatacaaaaaaatagagaaagttgctcaacaaaaactgatcgaaatgctgcccaaagagttacaacatgatttccgctgtctattggatgaacattattacagcgaagaggagaaagcgctggttaaacaagccgatgctctgtgtgcgtacctgaaatgtctggaggaattatccgccggtaataatgaatttattcaggctaaagcccggttggagaatacgttggcaatacgccaaagcccagagatggattactttatggcagtctttgtgccaagttttagtttatctctggatgaaatcagcctcgattcactggattgatctttatagcctgcttgtgcaggctataaattatgacaagagataattagcatttatttctggtaatattttctctcagcacgtttataggatccacaatactgaccgacccaacaaagctatttctgttttctatgactcttttcctgcactctgctcttttcttttcctctaccaattttttattttcggcaagaaactgctcagcagtcatcgcatgaacatatcccgcttgcatagaacctgcaagaaccgcaatgcaaaccgttgaaatcaatgacaacttcataaaaatccctttatttttaataaaaaaatttacataaaaaatgcaaatatcagtgtaaatataattcaatcagtgttaattgaacttgattatagttacacgcaatattaaatccatcaaacaaaactaatgaaataaatattatttcatgtttatctattctatttatttatataaaaatagattaagtttcagtgctaaataattagttttattttgataataaaatgttttgcgatagaaaacagatgagcctcgatatcactaaaataattcgagtggcaggaaagcagtcactaagtgacaaatcgatcgggagtaacctgaacacggcttacggtaagagacgaggcccacggatgggccaagtaacgaagacagccaacacaccggcaacttgaagtactacgggcatcgggtaatcagaatgggaatagtaagggaaccaccatcacactgacgatcatgaccagtacagtaaacggcacccccatacggacgaaatcaccgaatttataacccccggggcctaagaccaatgtattcaccggcgaagatactggcgtcataaaagcagccgacgcggcgataccaataatcatggcgaagggatacggagaaagcgccatctcacgggcggtcgcaatagcaattggtgccattaatacggcggtggcggtattagagatgaacagcccaatcgtcgcacacagcgcaaataagcacagcagcatcacccttggccccattccccccgcgacatccattagtccgcgaacaatcaaatctaccccaccagttttctgcaatgcctgggcgaaaggcatcatcccgataatcagaatcaaactcggccaatggattgaacggtaggcactttccatatcgatacaccggaactgccccatcaacagacaggccaccagcgcggcaatgacattcgggacttcgtcagtcagcatcatggcaaccatgagcgccaggcagaatagcgcatggggagcctgcgaaatggctggcgcaacttcatcaacttctgcgggcaggttcagaacaataaaatcgcgggtttttaactgtaactggcgaatcaatttccaatcgccgatcaccagcaaaatatcgccaaactgtaacttgtcatcaaccaacttgccttctaaggtcttaccgttgcggcggatccccaccacgttcaaaccataacggctgcgaaaggccacctcacgcaaatttttccccaacagtgctgaatccgggatcagcgaaacctccgccatccccacattgcgggattgttcagagaaatactcaccacgtaacaccagtggttctagcatctgttcgctacagaattcacgtaagtccatatcacaatcggacatatcaatcagcaacacatcattttcacgcagttccgacgagcctgtcgcactcaccatcacccgccgaaaacgccgccaccgttcaatacccactacattcgcgccataacgggcgcgcagatgcaattcatcgagtgaacgaccaatcaatggggagccatgacgaatagccagacgacgggcacgaccggtcagcttataatcgcgaatcagatcacggaaggtacgccgcttccattgatctttctcagtgtgttcttgtttgccccccagccagcgccgggcaactaacatgtaagccacgcccatgaacaaaatgataatgccaattggtgtcacgccgaagaacccgaaccctttgatcccttcgcgcactaattcactgttaaccaccatattgggcggggttgctaccagagtcatcatgccgctgattaaaccggcaaaactcagtggcatcatcaaacggcccggtgagattttcatccggctagccacactcagtaccactggaataaaaatcgccacgacgccagttgaactcataaaggcacccaatccggcgacggtaaccattagcagcgctaacatttttgtttcactgtggccggccactttcaccaaccaatcacccatttggtaggcgacaccggtcctgactaacccttcaccaatcacaaacaacgcagcaatcaagataacattgggatcactgaacccactggtagcctcagataatgacaatgttccactcatcacaaaggcaataatcaccaacaacgcgacgacatccattcgcagtttattcgtggtaaacagcacaatagctatcagcagtagcgtcaacacccacagtagttcgctgttcaaaatggcctcgttggcaaaacaaaaagtgaaagagaatattcggctctggcagtaaaacattaaatttaccgagggccgctgtctgagatcaataatgactgcaaatttatgcgcttactatcccaagaccgcattaatagcaagatattctgcaaagaaaaggctttcgatgagaggatcggacggatcgcctctttaacgatacaaaaaaggtgccgtcgaggcaccctactattggcttatcaccctacgacagcacctgtaacgggataccgttagccgccatgcagattaaggcagtaaccgaaccaccgcaccatgagcagtggcgtctaccaccaattgctccagtgagtgaagcaccagatcaacctgatcgagttttggggtatctgttggtgcattaaccgcgatcacctgacaaccggccgctagccccgaaaggatcccggcgggggcatcttccaccacaatacaatccgcaggggcaaggcctaaacgttcggcccctaataaataggcatcgggcgcaggtttaccctgcttcaccaattcggcggtcacaaacactttcggctctggcaaacaacctgccgcccggcgagctgaggcaacaggtatcgaacctgaagtcactatcgcccacggaatagccagttcattcaaccgggtcaacagtgccaccgcccctggtagcgcagttaccccctccgtatcattggcttcaatttgctctaatgccagaaactcgtcctgaatttcagcttcactggcacccggcataaaatgacgcaaagaggtaatcgcttgtttaccatgaataaaatccagaacttttgatggattaacgcctcgacgttgcgcccagccaatccaggcacgttcaacaacaggtagtgaatcaaccaacgtcccatctaaatcaaaaagaaaacctttacactccacaagcacatccccttaaagcctctctcccctcgcggttgacgttggatatcaatcggcggggcaatattatttgtatcgtgaaccagaacagcatcgaccttccaacacggctctggttacgtctttatccgtcgacaaacttagcaataatagcagcagattaatcaggcattaataatttgcgaaatttcgacggcgctcaaatgatattgccgtggacatgattgccaaatagccagcatccgctggtatttatcccacataggcgtttgggagttgaaaccgtgggtacctgaatcaaagtgggtatagcgcccttccgtattgaccataaaccggacataactgagataacgggattccgtggccgcatcaaaaccgaggaatgaaatacggcgttcatccaggtcctgcttctctttcaagttcccccaagagacctgtaaagcgtgatgcatctccatgatattaatgatagtacggcaagtatcttcgctcatctcaccaaagtcgcgatccaactcacgcatttgcagaccaaatccccgctcaacaatggtttgctggcgacgataacgctctgcattttccggatccaacatggtcatcattttgtactgatttgacagaatcagtcgttgggcgtttgtcatatccatcactaaactcctaaggcataaataatgagtaaatcatcgcatacaggctgggagcatactttgatttgacaagggattttcacagggaattaccggcgacaaacaataaaaattcacgatttatacccgtcatatttcaagctacaacagaaaaaccagcccctaatagctataacgtcaagcaataaggcgcgacctccggctttaactctcgcctgctgttttagctgtttttggctttaaactgctttaaactgctttagaaaatagagaaacatagaaatagagaaatagagaaatagagaaatagagaaatagagaaatagagaaataccgcgcttacaaatcatcgagaaacgttttgtctaactgtttaaaggcacgttttagcagatcagccaaagactgataagttgggatcggttcgatgggggcgaccgcttgccctgcttcggacagtttatgacgcacttcatgaaaccactgcaataacgtagggggtaacggcgtgatcgcccgtttacctaaccaccataatccttgcagcggtaaaccgcaggcaaagagcgccgtggcgatcgctggcccaagttgcccccccagcgctatctgccaggtcagggtaaaaatggccaatgggggcataaaacggataccaaaacgggtcactaccgtgacacgattctcggggaacaccggagccaagcgcttgtccgctggccaggtcttcatataatgctgaccgcgctggagtacctgaaaccagcttaccgaatcagagggtttaattgtcatggctcacctcaacttcataaacaaagattaaaattttttttgcaacccgcaaactaaaaattagtctgttaaatatattttgtttttagcccgcgctatcggtatcctagcccggcctttaggccgctagaagatggcactgaatatgtcaaacttttatagcagttaaataacttttgttaaattttatcgacttttatcatcaggatttaacgttttatcagagatttctctatcatcatgcttttttgctatcgcatgatgttaatcattaatgtcaacgccattatgcgctacgcttttgggcagattgacgttttattaactccgtatttttcactgtttttgtggagtcgatgggacaatacgcatcggtcttgcaaaaaacaaatgttaaacgcgactatacataggtacttccatgtcgagtaagctagtactggttcttaactgcggtagctcctccctgaaatttgcaatcatcgatgcgaccaacggtgaagagcatatttctggtttagccgaatgtttccatctgccagaagcccgtatcaaatggaaagttgacggcggtaagcaggaagcagcattgggtgctggtgcagcacacagcgaagcactgaattttattgttaatactattttggcacaaaaaccagcgctttctgctcagttgacggccatcggtcaccgtatcgttcacggcggcgagaaattcacttcgtcagttatcgttaccgacgatgttattcagggtatcaaagattctatcccgtttgcaccactacacaaccctgcccacttgatcggtattgctgaagccttgaaatccttccctaatctggcggataaaaatgtggccgtctttgacaccgcgttccatcagaccatgccggaagagtcttatctctatgctctgccgtacagcctgtataaagatcacggtatccgccgctatggcgcacacggtaccagccacttctatgttagccaagaagccgccaagatcttgaacaagccgttggaagaactgaacgtgattacctgccatttgggcaacggtggttcagtaaccgcagtgcgtaacggtaaatgtgtcgatacgtcaatggggctaacgccactggaaggtctggtgatggggacccgcagtggtgatctcgatcccgctattatcttccatctgcatgatgctatgggcatgagcgttgatcaaatcaacacgttgctgaccaaagagtcaggcctgttggggctgactgaagtcaccagcgactgccgttatgttgaagataactacgccaccaaagctgacgcgaaacgtgcgatggatgtgttctgtcaccgtttggcaaaatatatcggttcctataccgcgctgatggatggtcgtctggatgcggtcgtcttcaccggtggtattggtgaaaatgctgccatggtccgtgaactgacgctggacaaattgggcctgctgggctttgagattgaccacgaacgtaacatggcagcacgctttggcaagtcaggtaccatcaccaaagatagcagccgtctggctctggttatcccaaccaacgaagagttggttatcgcgcaagacgcagcccgtctgactgcgtaaataatacttctatacccaaagtcattggcgttgtaggtaggctgcgaacgaatcccgatgagtctcttcattttaaggttaacgacccgtaaatgattcgggtgagtgaacgtagctaaccccctgcaacgccaaggataaaggggataccttaaagaggcttagccgtgtcccgtacaataatgttgatcccaacaggcaccagcgttggtttaaccagcgtcagcttaggtgtcatccgttccatggagcaaaaaggggtaagcttgagcgtattcaagcctatcgcccagccacgtgcgggtaatgatgctcctgaccaaaccacgaccatcatccgggcgaactccagcatcactgctgctgagccgctgaacatgaactacgtggaaaccttgctgagttctaaccagcaagatgtcttgatggaagaaattgttgcccgttatcacgaaaataccaaagacgcagaagtggttctggttgaaggtctggtgcctacacgcaaacatcagtttgccaatgcactgaactatgaaattgctaaaacgctgaacgctgaaatcgtctttgttattgcccttggtaatgactcgccagatcagttgaaagagcgtatcgaactggcccgctccagttttggtggcagcaagaataaaaacatcactggcgttatcatcaataaactgaatgccccggttgatgaacaaggccgtacccgccctgacctgtctgaaatctttgatgactccaccaaggccagtgttgcgaacatcgatccaagccagctattcgctaacagcccgatccctgttctgggttgtgtaccgtggagcttcgagctgatcgccacccgtgccattgatatggccaagcacctgaatgcccgcattattaacgaaggcgatattaaaacgcgtcgagttaaatccgtgacattctgtgcgcgcagcatcccgcatatgctagagcacttccgtccgggttctctgctagtgacctccgcagaccgccctgatgtgttggtgtctgcctgtttggcggcgatgaatggtgtggaaatcggtgccatcctgctgacgggaggttatgccattgatgatcgtatcaataatttgtgtgaacgtgccttccaaactggcttgccagtatttatggttgataccaacacctggcagacctctctgagcctgcaaagctttaatctggaagtcccagcagatgaccatgagcgtgttgagaagttgcaaaactacgttgccagccatatcagcagcgagtggatcgactccctgaccgccgcctctgagcgcccacgtcgcttgtctccaccggccttccgctatgagctgactgagttggcccgtaaagctggcaaacgtatcgtactgccagaaggcgatgagccgcgcaccattaaagccgcgtctatctgtgctgaacgtggtatcgccacttgtgtcctgttgggtaacccagaagagatccaacgcgttgccacatctcaaggtgttgagttgggtaaaggcgttgaaattatcgaccctgttgcggtacgtgagcaatatgttccacgcttggttgagctgcgtaagagcaaaggcatgaccgaagtggttgcccgtgaacagttggaagacaacgtggttcttggcaccctgatgctggagaaaggggaagttgacggtctggtttctggtgcagtacataccaccgcgaacaccatccgcccaccactacagttaatcaaaactgcaccgggcagttcgctggtctcctctgtgttcttcatgctgctgcctgaccaggttctggtgtacggcgactgcgcgatcaacccagatccaacggcggagcaactgtctgagattgctatccaatcggctgactctgcggcagcctttggtatcgaacctcgtgtggcgatgatctcgtactccaccggtaactccggtgccggtagcgatgtcgaaaaagtgcgtgaagcgactcgtctcgcccaagaaaaacgcccagatctgatcatcgatggcccgttacagtatgatgcggcaatcatggcggatgtggctaaatctaaagcgcctaactcaccggtagcaggtagagcgaccgtgttcatcttcccagacctgaacaccggtaacaccacctataaagccgtgcaacgttctgccgacctgatctctatcgggccgatgttgcaagggatgcgcaagccggtgaatgatttgtcccgtggtgcgctggtagacgatattgtctataccgtggcgctgacggcgatccaatcagctcaggctgattcagccgcgtcttaatctttgggttcgcatgaggttattgacaaagtgcccgcgacggagagaacaggcagatcgtaaagacgccgtaaatacatccatgtaggctcgagccgcgccatccttggcgcggacgctttactcccctgcctatcctcaccgttcaagatcgcgtcatcggggtttgtcagcagtctgaaacgccagcctctgcgctggcgtttttgttacatcagacacgtaaaacagggagccgccctgcattctggggcggttttcctctttaggtactttgccgtggttcaaatttatagttaaaactttggctgaggggcacacttttcactccggcatcatcctcattgagcatatcaatcagcatcttaccggcctctttccccatttttttataatcgatacgcattgaggtcagcgttggatgagtttgatcacagctctctgagccatccaggcaagcaaccgcaatgccgccagggattttaagcagccgccgctggcattcaaacagcacaccaagtgcaatatcttcgtggctgcatatcactgcatctaattcaggctggcgcagtaagatctccgtcaaggcataacggccaaattgtaagctggccgcatcaggcgtggtgaccgtttggtcagcatttttgtaatgctcgagcatcgacttatgccatccattgagctgctggcgttgcaactgattatcccgatgcgcccccagatagccaatatgttgatagccacgctccagtaagtgacgggttaattcataagccgattcaaagaaagccgcttcaagggtaattttagcccctttaaaataggagccgacaacattaacgataggaatattggtgcgctcaagaatctgatatgtcttatccgccaactgcgagccaaatatcaccactgccgccgggtggctttgcagtaacgtcatgagaatctcagcttctttacgttgattgtattcatggcaacccagcaataactgaaattcatttttattgagaatttgctgtagtgcctgcataaaccgagagctggctttatcggttaaagacggaatcaacaccgccacggtatcgctgtgccctgacgctaaagcaccggcggcacggtttggaatgtagcctaatttttcaaccgcttgctctattttctcacgtaacttatctgagacctgttccggcgttcgtagcgctcgggaaacagtcatcgagcctaccccagcataatcggctacttcctgtagcgtgacccgcccggtattacggcgcttgcgtattttttccatgctgattccctgtctgctgaaacctggccattcgaacgggcttcgacaatgtaacgcgataccggccatatcacgcgataccggccatacatcaagcggcatctgcgctggctgcgcttgttactcggcccgtttatgacctttcctcgacgaagctgcggtaagcagcctttctaccactcaaattatttagaatatatatacctgatctgaagataacccaatctcatggcatgacaaatgatagcgctatcacaaattttgatagcgctaccagatagcgctatcaattgagatccagatcacattaataagcctgataagtatctactctccggttaacagtcatagggagtcataaatttcatgttaaaaacactgttaacgtcggatgtcattcaggttgtcagccaggcaaaagattggcgtgatgctatcgcgatctcatgccaaccgcttatcgataatggtgcggtagaagctcgctatgttgaagcgatttatcgctcccatgaagctattggcccttattacgtagtcggtcctggtattgcgatgccacatgcccgcccggaagacggcgtaaatagactctctctggcactaactgtcatcaccgagggggtcactttcaatgcagaaggtaacgacccggtaaaactgctcatcgtgttagcggcaacagacagcaatagccatattgaggctatttcccaactcgctcaattgttcgataccgatagtgatgtgcaagccttacttaatgctaaaacaccgcaggatattctgtcagtgattgcacgctattaatcacggtattcagttcgcatatataaaatcactctccaatagatttcaagatacagagcggcggcaactggatggcacccaagagcggacacaagtcagtaattagggggaacgaaggaagccaacgcatctgcaacttgcaagataacgagtaaaaaaggaaagaaaatgaaaattacagtggtctgtggtaacggtttaggaaccagtttgatgatggaaatcagcatcaaaagtatcctgaaagaattagccgtcagtgctgaagtcgatcatgttgacctcggttccgcaaaaggtacgccaagcgatatctttatcggtaccaaagacattgcagagcaattagttgctcaagcagtgggtggcaaaatcgttgcattggataacatgatcgataagaaagccatgaaagagcgcttatctgcagcattaaccgaactaggcgctttgtaagcggaggctgtcatggatttctttcgtttcttaatgagtgatgtgctttctgaacccgcaatactggtcggtctgatcgctttgattggccttattgcccagaaaaaaccggtgactgagtgtattaaaggcaccgtcaaaaccattatgggttttgtgattttgggtgcaggcgctggcctggtggtttcatctctgggtgattttgccaatatcttccaacaggctttcggtattcagggcgtagtgccaaataacgaagctattgtttctgtggcacagaagagtttcggcaaagaaatggcgatgattatgttcttcgctatggtgatcaatatcctgattgcccgttttacgccgtggaaatttatcttcctgaccggtcaccacacgctgtttatgtccatgatggtggccgtgattctggcaactgctgggctaagtggcatgatgctgattgccatcggttccgtggttgttggggtagcgatggtcttcttccctgccattgcccacccttacatgaagaaggtgacaggatctgatgatgtagccatcggtcacttctctaccctctcctatgtattggctggttttatcggcagtaagtttggtaataaagaacattcgactgaagacatgaacgtgccgaaaagtctgttgttcttgcgtgatacaccggtcgcgatctcctttaccatgtgtatcatttttgtcgttacctgcctgtttgccgggccggaagtggtgaaaagcctgagtggcggtaaaaactggttcatgttctcattgatgcaatccatcacctttgccgcaggggtttatattattctgcaaggtgttcggatggtgattgccgagatcgtgcctgcttttaaagggatttcagacaagttagtgcctaatgcaaaacctgcgttagattgcccggttgtcttcccttacgcacccaatgcggtactggttggcttcctgagcagctttgccgctggcctgatcggtatgttcgcgttgtatttgttgaatatgaccgtgatcatcccaggcgtcgtccctcacttcttcgtaggtgctgccgcaggggtgtttggtaatgctaccggcgggcgtcgcggggcgattctcggtgcatttgctcaaggtctgttaattaccttcctgcccgtcttcctgctgccagtcttaggcgatattggttttgccaataccacatttagtgatgcagattttggtgcgctgggtattttactggggattatcgttcgataatttgctttctcagtaaagacgtcaccatcaccccctccttggagggggtttaaactgataataaaaaaccaaagcactttagcggggctttggtttttttattgagcaagtgggaattacgcttcgcggggagtgattttgccgtaatcctgttcgttgttgcgcgtcagccacagtgataatgctttgagcgaatcaggtgtaaattcgtcacagcgggcggtgatctcttctggcaccatccagcatacttcatcaatttcctctggttgtaacgcaaaggggccatgagacacacaactgaataacgccccccatactcggcagcactcttcttcaaaatagaattggccgtgttccgcgaacggcacaccggcgatccccaattcttcttcagcctcgcgccgagcggattcaaggtagttctcgccactttgcacaacgccccccgccgtagcatccagtttgccgggatgaaaatctttgctctcagtacggcgttgtaccagaattttccccattccatcgtgcaccacaatataggtagcacgatggcgtagtcgctgagctctcatttgctgacgactggactgagcaatgacgttattttgctcatcaacaatgtcaacccactcgatgactgctgctggattttgctccaccatcctctgaaaccttctatctaggcgcgatgatatacgcgcacatgttaatcaagagtatctgttagtaaatgctatttttaatcaatgacttaatcttattacctgacgccgtaatcggtgagttggctgccgcgtcactgactcctgtcagcacttgggcatttactcaattgccgccttcctacaactcgcattattggggtataaaagctgtgtattgattaattttttagtgccaatcgggcgacaatttcatcaccttgtagggtaagaacctgcaaaacacccttgtccaacatgccatagctcgccgggtattccccctttgggatactcacggaacctgggttaaaacagatgatatcaccttgccattgtgcttgtggcaggtgggtatgaccataagccaggacatccccatgacgcaatggaggaagcgcaccgggatgataaaggtgaccatgggtcaggaataaacgtgtttcaggcataataatctgctgccaacccgccatgatggggaattgaagtagcatttgatcgacttcactgtcgcaattgccgcgcacggcaataatgctatccttgtaggcattaagagactccgccaccgctgcaggttgatacccctcaggtaatgcattgcgcggcccgtggttaagtaaatcacccagtagtaccagccattgagcaccgctgtgatcaaagatcgccaaaacacgttccgtggccggtaacgaaccatgcaggtcagaagcaaacattaacttcatgatatcgttttctctctggtcatcatctcaataataaaagaagcgctattctatcacccaatccagcagattaatccgataaaagtcagtatctaccatgagaaaattttgtcgaaaaggatcgcgctgacagcccagacgaatacccgcgcgatacagcctatcaaggcgcgctttgccaaaaacattaacgcaaaggttgggagactagctcatccaatgtcatcgggttaaatagatacccctgcatagcatcaatattactgcctgcgagttgctcagactccccctgattttctaccccgacaacaatgaccccaagacaatattttttaatgttgttgatcaatatcgggaaggtatgtttgttgtgctgccagaagaaatgcttatcaatttttatatattcaaagatattggcagtcaccgcgttcaatgttgagcctccgctgcctaaatcatccaaccataatggatacagtgaggctaactcacgtagcaagggattattcataccatcggataaattggagaatgtctccatgatttccagccgtaaaaaaggcatttcatccagcaactgccgggtgggcgcatcagtaacaatcacactcgctaaatcaaaatcaatattgatcgaaagcaggacattgttcgtgataaaccaatcactgtaggcttttaccgcctgcaattgattttggaataaatcgttttttccgtttatgtccaattcattaataaatttttcgacatcaataggtaaatcaacgggtgtcgctgaaaatcggcttaacaattctactgccaataagctgccgtcttgcttacgtatgggttcacagacataagaacaattaactttgatatttagcttcatacgcacctggaaaagtatatagataacagtaagatcgttatccgatctcagcaggaggattgataaactatcgctaatcttttattaaacgcctaacattaccctatttatcggccatgttgagcggtttattgagtccctgattcttttttttattttttacaataatgattccgacaactgcggctacttacccatgagcagccttcctattttaagtacaaaaaagaaatattcattcaggatgtgctcagtgtcgtgggataagagcacagaatcgcctatgctaaaagagaaaaagaaatagatgaggttgatgacttgataggattggatttaaatggagattggctatgcgtattttaatcaccggtgctacagggttgatcgggcgcagcctgaccccctttcttctgtcgcaaggccaccaaataacggccctgacccgctcactgcagcgggccaataacctgctcggtcagcaagtgacctactggcccactctggatgatcaagaggatctcaacagttttgatgccgtgatcaatctggccggagagcctatcgccgagaaacgctggacctcgcagcaaaaagagatcctctgccaaagccgctggcaaataactgaacgcttagccacgctgatcaatgccagcagccagccaccaaccgtttttatttccggttctgcggttggattttatggcgaccaagggcaggcattagtcaccgaagaagagcctccccacgacgagtttacccatcaattatgtgagcgttgggaaaatctggcactggcggcggagagtagccatacccgagtctgcttgctgcgtaccggcgtcgtattagcgccagaaggcggcgcgctagccaagatgcttcctctattccgccttggattaggtggccccatgggggatggtcgccaatatctgccttggatacatctcgaggatatggtgcagggtatttattatctgctaaccacccataatctgcgcggcccgtttaatatggttgccccctatccggtccacaatgagcaatttacggcgacgctggccgatgttttggatcgcccagcagccatccgcacacctgcagcagccattcgtctattaatgggtgaatccgcaatattggtgctcggtgggcaacgggcgttaccgaaacgattggaagaggcggggtttggctttcgctattatgaattggaagatgcactgcgtgatgtactgaaaaaaccaaaggaataagcagctggcgttccctaataggggtgaggggtgaaccgtgaaagggtattcacccccctaaaatacagctatccattaatacaactatccattagccattttattagctactcattagccatcttatttcagtgagccagaaagaaactgctgtaaacgtgggcttttagggttaccgaaaagctcagcgggtggcccttcctcttcaatgacccctttatgtaagaaaataacatggctggaaacatggcgggcaaattccatttcgtgcgtgaccaccaccatagttttcccctcttccgccaacttttgcataatacgtagcacttcaccgaccaactcaggatccagcgccgaagtgggttcatcaaacagcaatacatctggttccatggccagtgctcgtgcaatagaaacacgctgttgctgccccccagagagatgtacgggatatttggcccgcgcccgttcatcaataccgactttatccagatacaaaattgcacgctctttcgccaccgatttacttaatcccagcacttgaatcggtgcctccatcacgttttctaataccgtcatgtgactccacagattaaagtgttggaagaccatcgttaaccgggtgcgcaataattgcagttgttttttatcgaagacttttaactgaccatcgctatcccgtaccaagcggataacctgattattcacgcttatcgatccttcactgggtttttccagaaagttaatgcaacgtaaaaatgtacttttccctgaaccggatgaaccaataatggaaataacatcccccgcgttggcagagagcgaaacaccttttaatacctcatgctccccataatgcttatgcagctccgtcacggaaagttttgtttccgcatttttaatataggacgtattcgtcataaagttctccgcactaatgcgatgcctgaggttgaatatgggctaaccaacgtttttctgcttggcggaacaggctaattagcgtaaaggagatgctcaaataaagtacagcggcaatactgaacgcataaaagggttggtaagtcgccgcgttaatatcgcgagctattttcaatatatcgggtacggtcgcggtaaaagccagcgcggtggagtgcagcattaagatcacttcattgctgtatgccggtaaagagatacgcaatgcagcaggtaagataatgcagcggtataatttaaaacgtgagaaaccataggcgcgtgctgcttctatttcaccatgaggtaccgaacggatcgcaccggcaaaaatctcagtggtataagcacaggtattaagcgtcagcgctaaaatagtgcaatttaatccactgcgaaaaaaagcattgagcagatcattgcctcggattatctccaaactatacattccggaatagaacaccaatagctgcacatacagcggtgtaccacggaagatataggtaaaaatccatactggtaaacggatccatctccgttcagacacccgagcaaccgccaatgggagcgccagtaacccccccatgacgaccgaagaaattaataaccagagagtgaccgccatgccggtaaagcggtagccatcactccaaagtaatgcctgccaatattgatgtaagatttcaatcatagctcagccctcttcaccccatgggaatagcgcctttccagccaccacaagacaccgttagagagagtggtaaagaacagataaatcgcaccagcaaccaaagcaaagaaaaacggctgataagtgccttttcccgccaattgggtggctttgaccacgtcattcaagcctaaaattgacaccagcgccgtcgctttcaggatcacttgccaattattaccgatgcccggcaacgcatagcgcatcatggctgggaacataatgcgacgaaagatctggctggaggtaaaaccaaaggccgtcgcggcctcaatttgccctttagagaccgccatataagcgccacgaaacgtttcagtgaagtaagcgccatagataaagccaagggtgataaccccggcagagagagggtcaatatcaatttgtacaaaaccaagggactcggtaatgctattgagggtaatctgcaaaccgtagaagataagcagcatcaaaaccaaatcaggtacgccacggatcagtgtggtgtagcactcaaacaagcccgataccaaccggtttgacgataacttgccaccggcccccatcaagccgataaccactgacagcagcaccgagaacaatgctaactccagtgtcaccagcgcaccttcaaatatcagtttggaatatccatccagcatctgtgggttatcctgttttactgagtgaggagtctggttaattacggtatgttagcccctgccacaatcgacagaggccacgacgacaaaaaggattaatcaccgtaaacatcaaaatcgaagtattttttggcaaattgatcgtaggtgccgtcattacgcatttcagcaaacgctttatttaacgcctctttcagctcaacatcggctttgcgcaaccccatgccagtccctacaccgaagaattgatcattttttactgatggaccggcaaagatataatctttacccacaggttgttttaggaaaccttcactggcggccacttcatcctggaaagccgcatcaatacggccagaggccagatctgcataaatcagatcctgattttgataagcaacaacatcaatgccttttggctgccactcagcattggcaaaagcttcctgagtcgacccttgtaacacccccacgcgcttaccttttaatgccaccagtgtcggctcaatagtgctacctttagcagcaattaaacgggaattggcggcaaagagtttatcggtgaaggcaatctctttttggcgtttttcagtaatggagagagaggagataatggcatcgacttttttcgctttcagcgacgggattagcgcatcaaagtcactttcaacaaaagtacatttggtatctatacgtttgcataactccttcgcgatatcgatatcaaaacccactaattcaccactcgagtttttcgattcaaaaggggcgtaagtcggatctgtgccaattttgatctcttttggaatggcggcaaaagcactactagccgcagcgaatgcgaataccaaaggaagaactcgcagctttttattcataaacataaccctcaaattgatttttgatgccacaaagcgcgttagatttctgtccaagcctgagcgtccataaatcaatttgcagtaatcgtgccagtaattatctggagggaaaatcaattccaccctactgtttctttgcacgataacgactaaaatcgatatacccgtcatgctgcaaattgcctgtgctgaccgccttcgttcacccacagtcacttgccttctataaggccctgaagattcgcttggttgccgccttcctgcacgcaaattatttagggtataaatgtcatgacatctggtcgtgaacagaaacagaatacaaaaaccctactacagcaccatcgctgttgcaggatcattgtggagcatagtgtgccccatttcagtgctatgttgcacaaatgtatcaattaggtgattaatcatgttgattgcatgattaaatgtgtccctgaggtgattaaatgtgtcaatgaggtgattgaatgtgtcaatgagggcaatgagggcaatgagggcaatgagggcaatgaatgttagtttttaccttgccagcgcgtaaacagatctttaggtaactcaatatcaaactgatcgatgatgcgattaactgtttgatcaataatgtcctgaatagtttgtggctgatgatagaacgcaagcattggcggcataatcacagcacctaattcggcggcttgcaccattaagcggaggtggcctaaatgcaggggggtttcgcggacacaaagcaccaaacggcgacgttctttaaggatcacatcggcagcgcgggtcaataaaccatcggtataactatggacaatgccagacagtgttttgatggagcaaggtaaaataaccatgccatcggtcttaaatgaaccagaagagatacaagccgcaatgtcccgaaaatcatggaccacatcggcaaattcttggacgtccttgacgctgtagtcggtttcgagcgccagtgtttgacgggcagcattgctgataatcaaatgggtttccacgccttcgacatgttgcagcacctgtaacagccgcacaccataaatggcaccacttgcaccactaatgccaataataagtcgcttcatggaaaactgcctcatactgatgctctatcgcattaaaatgtccaatatatatgcagaaaacatatctattagcatgataccaaactttgccgcatcaggtactaattagcaagttatagcaaaacaccatgaataaaaaggtgcaccgcgcctaaacgcaggttgcacctttttggctcattctgttttatgacggatactcgtcatacttctacccgccatacttcaagacacagatagaggagattaaccttcgttatgcatctctaaattttccgcttcattgtggctacgcaatgcctgcgcatcgtcgttacgtaatgactcaagatattccagatagctctgatccacatctttcgtcacgtaaataccattaaagacagaacattcgaactgggtaatgtctggattatcttcacgtactgcatcaataagatcagtaagatcttggaaaatcagtgcatcggcgccaatcaactgacgaatttcatcaacttcacggccatgagcaatcaactcattagcacttggcatatcgataccgtacacattcgggaaacggatttcaggtgctgccgacgcaaagtacacttttttcgccccagcttcccgtgccatttcgacaatctgctctgacgtggtcccgcgaacaatggaatcatccaccaataacacgtttttaccacggaactcagcacgattagcattcagcttacgacgcaccgatttacggcgttcttgctgacccggcatgataaatgtacgcccgacataacggtttttgacaaacccctgacggtacggtttatccagaattcgggcaatttccagtgcgatatcgcaagaggtttctggaataggaatgacaacatcgatatccatgtcttcccactgtttggctattttggtccccaacttctgccccatgcggacgcgcgcactgtaaacagaaattttatccataaaggagtctgggcgggcaaaataaacatattcaaacaagcatgggttgtattttggattctcagcacactgacgcgtgaacagttggcctttctcggtgatatacacggcttcgcccggtgcaacatcacgcaagaattcaaaatcaagtgtatccaaagccacactttcggacgcaaccatatactcattgcgcccatcagccagcgtgcgtttaccaattaccagcggacgaataccgttggggtcacggaaagcgaccataccgtggccgataatcattgcgacgcaggcataagcaccacgaatcaactggtgcgtcgcggcaacagcggcaaaaatgttgtcagactccaacggataatgctggaaacgatccaattcactggcaaaaatattcaacagaatttctgagtcagacgtggtatttacatgacgacgagaaacttcgaataatttctttctcagttggtgagcgttagtcagattaccattgtgagccagggtaatgccaaacggtgagttaacatagaaaggttgagcttcagaagcgctggagctgcctgccgttgggtaacgaacatgaccaatccccatattcccctgtaaacgcagcatatgccgggtttcaaatacatccttcaccaagccgttcgctttccgcagacggaacccattatgggcatcaatggtaacaatacccgccgcatcctgaccccgatgctgaagcaccatcaacgcatcataaatcgactggtttaccggtgtaaaaccggcgataccgacaataccgcacatgttgtcttttcctcataagccgcttcgaatcggtaattgattcggtaagaaactcgacgtgctctgcaggtagtcaaagaaccacctgatgatataactgaactgcgggattaattgtgactgcttccaatcaacactctgtgagaagccggtaaacgtatccagaaagaacaacatggcagagacaatcagtacacctcgcagtgccccaaaacagacccctaacaccctatcggttcctgataacccagtacgctccaccagtgaactaatcacatagttgacaatcgccccgacgatcaatgtcgcgatgaacaaaatgccgatggcaattccgttgcgaacaatttcatcctcaaatcgggtgaaataaacagcaaggtaagtgtaaaaatggctggcaacaaaaaacgcacatccccatgttacaagtgacaatgcttcacggacaaaccctcgaattaaactgactaacgcagaaaacccgataattcctataatgacgtaatcaatccagaccatgactattccaataacgaaaccgccgctgcatcttgttcgcggcgaattctaacagaaaaagaaaacgtttgcgtaggggtttctaaccccaaaacaaattaaagtgtgacgactaaaaaacaaccataaccgcatggaaaaacacaattaccgtataaaaaatacaaccaccgcataaattgagccgctaaaaatctgtacccacggatatctcacacttcagttgtcatcctgacgcagtcggcaacctaagacagtaacaatttaagacagtacaatttaagacagtacaatctaggacagtagtcaccctaacgcgacgttgtataaggcttaacttgcccattcagaccacttaatgcattaagctcaggtaacgcggattgtaatttctgttttgatgcatccggcccgacatataaccgggttatctcaccctgaaccggcgtggcgggtacagtgaacgcccgatgccccgacaaccgcagcatcgcgacaatctcatttactttggctgcattttttagcgcccccagttggacaacataagcctgccccactggcgctttttcttccaccggcggtttgatttctggcttaggtttcacttccagcggttttttctctgctggttttgtttctatcggcttggtttctgtcggcttaacgtctaccggcttcgtcacggtaggttttacctcaaccggcttactctggattggtggcggtgccacaatcgtaggttcaacggcaagattgccggcatcattagccgcctgagaaaccgaatcatcgttgagttcggcgcctaccgcttgtgctgcaccttcgggcggcgtaatgggaagaggctgattgagcggcggaaccacatcaatctcttggctatcccctggttttggcactaacggaatagcagcaaactcatcctcatagtgcttctttttgccatccagtagccccggtaacacaatcacacctaaggcaactaaaataatggtcccgactaaacggttctggaactgacttgccactcgcactccccgcgtttatctcccgccggacttgaagatgcaggaagcgatcgtttactgcccgcctgcaactccatgctctttgggtttaaattcaatctgttataaactggacactgtcacaaatgcaatgctgccataacatgggcaacagtatggaaagagccacagacaatgaccacatcctgtgtatctgcatcttgcatagcctggcgccaggcagtttctacatcactaaactgacgtgcgctcaccagatgttcggccaattgcccagcactggctcctcgtggcccttcaagcggagcgcaataccactcatcaactcgctcagataaacatgccagcgtacccgcaatatctttatccgatagcatcccgacgactgcccgcactttgccttgtttcgacgcattaaccgggttaataacttgggccaaccgattgaccagataacgggccgcatgcggattatgggcgacatccagaatcagcaacggttgctcactgacgacctgaaaacgccctggtaaactggcggcctgtaacccctgccgaatcgcctcgtcactcaatggcaactcagaataatgcagtacagccagcgccgtagccgcattcgccagcggcacgttcggcaccggtaagccggttaattggcgctcaccgcactgccagtgccagccgtttatttgttgatcaacgggttcttgttgatcaaacggttcttgctggctgaatttccaggcaacatcccgacgatagagctgtgcgcctaactcagccgccacatcggcaatagactggggcatatctggttcacccacgaccgcaggtttaccgccacggaagacacccgccttctcgcggccaatgctttcacggtcataacccagccaatcagtatgatctaacgcgatactggtgatggcagcgacatcagagtcaacaatattggtcgcatctaaccgcccacccaacccgacttccaggatcaccacatcaagtttagcctgcttaaatagttgcaacgctgataaggtgccaaattcaaagtaggtcagtgagatatcacctcgcccggcttcgatctgggcaaaagagtggctgtgttctgcctcagatagctcttgcccctgaattcgaacccgctcggtatagcgtaaaaggtggggggagctgtagaccccgactcgcagaccggccgccaataaaatggcttccaatgtacaacaagtggtacctttgccgttggtaccggcaacggtaaaaattttgggggcaggtttaagcagatccagacgctcagcaacctgtttaacacgttccagacccaactcaatgggctgagaatgcaaatgctcaagatagcaaagccacgcggccaaaggcgacgtggcttggggagtttgatgattgttcatgagtcccgtcacttcccttggttttatccccgcgatactccaagttgcctgtacgctagctcccgttgttcctcccaatatcgaaaatgcttagggactcactcggttaccgctctcctgcaactcgaattatttagggcatattacacactcgttattgccaaattgtcgttattaaataacgcttattttctgataaggcacaataaccgggcaccatcttacaagagtgatgcccgttgagttaatcagacatctgcctgattttcaggctgggccacggtatctgctttgctctcaaccacgcttggctgcggctgatgagtcaatttagacaaaatgctcgccaaagtctgccgcataactggacggcgaacgatcatatcaatcgcgcctttttcaatcagaaactcactgcgctggaagccaggcggcagtttttcgcgcacggtttgctcaataacacgtgggccagcaaagccgattaacgcttttggctcagcgatattgatatcacccaacatggccaggctagcagaaacaccgcccatggtagggtcagtcagcacagaaatgtagggtaaaccgcgctcttgcattttagccagcgctgcactggtctttgccatctgcatcaatgacatcaacgcttcctgcatacgtgcaccaccactggaggagaaacagaccaatgggcaattatcttccagagcctgttcaacggcacgtacaaagcgagcaccaaccaccgacgccattgaaccgcccataaaggcaaattcaaacgaggcggcaacgataggcatcccttgcagcgtccctttcatggcaaccagagcatctttctcgccagtatctttttgtgcggctgaaatacgatctttatactttttggaatccctaaatttcaggatgtccttcggctccagttcgctacccaattcaacttcactgcctgcatccaacagcatatgcaaccgtgcacgggctgacatacgcatatggtgatcacacttaggacacacttccagattacgctccagttcagcacgataaagtacctgaccgcagctatcacattttgtccataccccttcaggaatactcgctttacgggtttgtgtgatattgcttttgttaagaattcgttcaatccagctcatcgatgacctttctgtttgaacctggctgttgccagtccgctgttcatgctttaaccatctccctgaaaactctccaataaaaaatgcctgagatacacgccagtgcgacgtggctaaggcaccgaaacttggattgtctgcaggaacagaccacaaatgttactcattaaaccatattgattcgacagtgtagataaaaaactggtgaacccacagcttatgtaacgtttttactgatttttttgacgtaccgcagcacgccgatgccgccaaacttcaaatacgcctggcaaaattgacaccacgataatgatcacaatcaataacttcagattattctgcacgataggtacgttaccaaacaggtagccagcataagtgaataacagcacccataccaacgccccaatcacgttataggcagcaaagtggcgataagacattttccccataccggccacgaatggggcaaacgtgcgaatgatcgggacaaaccgcgccagaataatcgctttaccgccatgcttctcgtagaactgatgcgtcttatccagataactgcggcggaagattttagaatctggattgctgaataacttttcaccgaagatacggccaatcgtgtagttaatcgcatcccccagaatggcggcaatcaccattagggtcaccatcgtgtggacattaagatcattggaaggcaacgaggccaaggcacctgcaacaaacaacagagagtcccctggcaggaacggtgtcaccaccagaccggtttcacagaataaaatcaggaatagaatggcgtaaacccatatcccatattgcgcaaccagttcagccagatgaacatcaatattcaaaataaaatctatgacgaaacgtataaattccataaatactctcgaaatgaataaacacacccaatcgttcgttaggcaagtgagattagctgaatttccttaggtattccttagcccaaagcgacgcctcagtttgccatcgacatacctgacaattggctctcggtatctttagtcaccggtgaaccgttaaccctcgtcatccgccaaaaacaaaggccccataggaactttgggtaacgcgaagtggtccgggtaatcgacagacactaaatacaacccatcggctttggcggttgcggcagcacgtgttctgtccttcaacgccaacaattctgccatccaggtcacgtcctgattgccacaaccaatttctatcaggctcccaacgatattgcgcaccatatgatgtacaaacgcgttggccttgatatctaccacgatatacgcgccatgtcgggtaactttgacatgttttacatttctccatggcgtgcgggattgacattgtacggcacggaaagaggtaaaatcattttcgccgagtaaacattgcgcggcgcgttccattttttctgcatccaatggcatatagcaatgggtgaccccttgcgccaatatcgcagggcgatagcggtggctaaaaatgatatagcgatagcggcgggccgttgcgctaaagcgggcatgaaaatcgttatcgacggttttgacccaacgcactgcgatatccgcgggcaaatggctgttgacccccatagtccaggcggcgtctttacgtactgcagaggtaacaaagtgcacaacttgcccggtagcatggacccctgcatcggtacggccagcgcagaagaccccaatgggttcattagccactttggataatgccgcctcaagacaggcctgcacgctggcaacctcttgctgccgttgccaaccaaaatagcggctaccgttatactcaatacccaacgcaattttcaaaccggccacttctgccggtttttcttgctgagccaatgtgttttgctgaactaatgtgttttgctgaactaatgtttcttcctgatctaattcaaacccggacatcagtatagttgctcctgtaacaggcgctctgccgtttgaatcgccatcaatgcgccaccaaaacgaatgttgtcagccaccgaccagaattgcagcacttcaggaataccataatcgttgcgaacgcaaccaatactcagggcatcgctgccggaggcgtcgctgacctgggttggataatcatcttcttcggacaattggatatcgtcacaattttccagttcgctacgagcttcttcggcagcgatcgggcgcaatgcctccagatgaaccacttgcgcatggccataaaataccggtgactgaatgcagcttacggtgatcggcaagccttcgtcctgtaatactttacgcacctgatcaaccagacggcgctcttcgctcacactgccctcttcatcggccagcagcggtaaaacgttaaacgccaattgcttagggaagatacccggttccgcaggaatgccattgagcagcttggcactttgcccagcgagatcgtccaccgccgctttgccatgtgctgaggctgaaatcaggttagtcacatgcaggcgagacagccccgcctgttctgtcagcggtttaatcgccgtcagcaactggctggtcaggctatcggctaccgccacgatattacgattacggtaatcagccagcacctgaggattgacgctcggcaccaccaagggaatatcgggttccatagcgaacaagccgctactgtcgatcaccagacaaccggcattcccagcctcttccgcatattgtgccgatgcttcacggcctgcgacaaagaaggcgagttgagcctgggaccagtcaaattcagccacattctcaaccagtatacttttaccgttaaaacgtacagtagcaccggcactgcgctcgctcgccaaaggatacaattcaccaactgggaactggcgctcatttaacagctccagcaaagcttcacctactgcgcccgttgcccctaatagagcaatattccagccgtcagacatgttggttttctccgctatagttcattggaataatatgagttcactgaatgatatgagctcattaaataatgattaaattattgaataacatgacgttattgaacagcaagggcggtaacacaccgccctgttattaatttttacgcgtgatattcgtactaccctatcgtcacagcaattgagtagtaaaacctagctgctgcaagagtccagcactggtagcatcatcgcactgtacacacagtgatgaccattcacgccgctcctgataatgcttgcgcaggcggtcaaactcccctggcaggccagcgacatggcgcaatggcgcgtcatcgcggcgcacatcatacactaagtgcatcaatcgttttaatttgccttcatccaactcaccatttagacgtaaatggctaaactctggcactggcaataaagaggccagttcgaccgactgtggttgccccaaatgctgactgaacgcctcaaaaacctgtgtggtaccccgtgctttgccttctagcgtatatccggcaatatgcggtgtgccaatatcgacacgggccaacagcggtaaagagagatccggttctggctcccagacgtccaataccacgctgagttttttccctttttccagcgcccgtaatagtgctgcgttatccaccaccgcaccccggcaggcgttgatcagaatacggccatccggtaaggcggccagcagttcatcatcggccatatgcagactttggtaggctccggttttattcagcggagtatggaaggtcagaacgtcagcctcacgtaccagtttttccagcggccagaaggcttcgttatcaccacgatcagcacgtgggggatcgcacaacaaggtccgaacacctaaggcttgcaaacgagcattcagccgtgaacccacatttccgacgccgataatgcccacggttttatcgcgcaactggaagccatcccgttcagccatcatcatcaacgcagagaaaacatattcaaccacggcgatagcgttacaaccgggggccgcagagaaaccgatcccctgctgacgcagccaagtgtcatcgacatggtcggtacccgccgtcgccgtgccaacaaaaccaattgaggtaccgtgtagcagcgcctcgttcactttggtgaccgaacgtaccatcagagcatcggcatcaaccaacgcgtcacgaggaatgggacgccctggcacagcctgtacatcacctaaacgccggaacagctcctcagcgtacggcatattttcatcaaccagaattttcactttgctctccgacagcgaactgccatacagatgaaaaacagggggcttagtataagccactattgccccgccggaaacgctcaggcgtggtacccgatatttgctgaaacatggcgataaaagcagaggcggagctataaccgacatctaatgccacactgtttaccgttttcccctgttctaacaatgagatggcatgtaaaaaacgtaagcgctgccgccattcgctaaatgccataccaagctcctgctggcaacggcgggataaagtacgttcggtggtatatacccgcttggcccaaagtgccagcgaggtgctatccgcagggcagcgctccaatgcggctaaaataggcgacaacagtttatcttgtgaagttggcagataagtccgctgcaccggtgacaccttgagttgatcaatcaatacatgggccagacgtctatcctgctgagtttctggcatcaataaatcacgtgtaaaacaatcctccacaatggcattaaagatggggctgacattcatcagtccaggtgacgccgggagttcggtacaaaaatccagcgcaatatcaatggcacgaaaatgcatgggtttacgattatagctagagtgctccatgcccgcggggacccagacaataaattcaggtggtgcaaggaaacgctgaccaccaatgctcatggccagaacaccggatttaacgcatatcaattgtccaaaaggatgtgtgtgaggcaaaaattcggtattggcattaaacgcttcacagcgaaaggacaaggtctgtgggatccttgaggtgactacaggaaaatcaggttctgtcatcgtccattatcccccgcagcaaaataatgctcttcatggttattgccttaatttcggtgatgaatgtcttcatcacccacgttattgtcttaatcacccaagtcattgtctgattatcgttatatagaataaatcagacagctgtagactacaccgcatattttttagttaagaattattatcatgaatgttttatttccattgtttgcggtgattatttggtcagtcaatgccgtggtgagtaaaatctccgccaccgccattgatccggcagcaatctccttctaccgctggttactggcactgctgacattatccccatttctgctgctcggtgtgatccgcaattggcaggcgatacgtgtctattggtggaaattaatgctactggggatgctgggcatggtgctgtaccaaagcctggcttactatgccgcccacagtgtcagcgcactgtttatggggatcctcagctcattaattccgctgttgacggtgcttatcagtattgtgttgttacgcgtggccccaaccgttgggattgctctgggtagcctgctgtccttagggggattagtttggttgatcagtgcgggcaacccagctcaactgctgcaacatgggatcggtaaaggcgaactaatgatgcttggcgcgtcagcctcttatgcgctgtatggggtattaacaaagcgctgggccattcaactaccgaattggcaatccctttatatgcaaatcgtttttggtgtcgtgctgctgttacctggcttcctgatgaccccagacgtgcagctaacggcacagaatattcctttggttctctttgctggtattccagcctcaattcttgcgccttatttatggattcaaggcgtgatgcgactgggtgccaataccgcttctatctttatgaatctgacacccgtatttactgccattattgccgtcgtcttcttgcatgagcagttgcacagttatcacttgattggtggcggcattacccttgctggagtggtgctggcccaacgtctgcgcagcccattgcggcgcaatttagatcttgctggacatatcccaaacaacaaaaacagtagatagcggcaagacttctggtagaaccccaagtgggtataaatatgtatacccaaaataattcgagtggcaggaagatggcaactgcgtcagtccccaggagattattgattttaagatcaacaacaagtcagtgattgtggtgataacgattattggcacttaaagtcaaaagagaaaatcaaaagcaagaagaatatattggtcgcgctcatttacaggtatcataatatcggcctgcgcctaccgccgggtttcccttatttcctccatagcgaaggaccggttatatgcaacctttgaacggcccaggcgttcccattggcaatgatcgccatatcacgcccactaagttgaccgcccaatccacggtggaagatcaggcgctaaccccagcgcagcgtactaccttagagaaactgatcgtacggattatggccctcagccccgtcaaatcggccgagatctgggccgggcttcgccataacctctccttggacgcaaccggtgatctccttgcacgtcacttccagccggccgagcagctactgcaaacccgcctgtctcaagcacaggaaaatcatgctagccaacagcttcgtcaacaactcactgcattattaccacaagggaataaccggcaggcagtcagtgattttatccgccagcaattcggccatacggtattaagccagttaagccacaccgagttacaacaagtcctggtgttattgcaatccggtacgctgaatattcctcaaccacaactgacaaccctaaccgataggccattgctacccgccgagcatcagaatattcaatcactggtggcgaaactcagtgccgcaacgggtgaacaacccacaaaaatctggcaaacattgtttgatatggttggagtaaaacatcatgatccgctacccgctcgccatttccagctactgagccagttcttgcaaactaaagtggccctcagccaacaaactgccccaacattagttaacctgcaaactgcccttaagcaaccagccgatgcacaagaacagcagttattggccgattacagccaaaaccgttttcaggccagcccaacgaccccgctgacacaggcacagctgaacgatattatcaatattctgtttgccgcccgattagagaaggccaatgctgcccaatatttagatgaagaacacaagccccttcagccactgattaacccgttcattgcctcactgccagagtcattacagcctttattacagaagccgtcactcgtggttgtggcattgattatcgtgatagcctttctattggcgatttttctttgagccaccaatagcccttcccccaagtaaaaaaaacctggctcagttcaaggtgactatttaaatacaaaaatacaaaaagcgactaatatcagtcgctttttaacaaaccgcttacgctgtatgccgctcaaggagaatttaggctgatggacttaccctacccattataaataattaatgtccggtctaatgcaattgtggaataactgggaaataccaattaataagatcgcatgaatggaagttaaaaaaattcattcttttatacagcatataaaaaagcatgcagaatatcttccacatgctttttttaagcaatttagacagcttaaaatctgtaattaattataagcgagggtaaagttagctacgctgctgaattcgccggggaccacactaccttcatctgcactggtacctttcaggtaagcagagaatttcaagctgttactgccctgatccagggtcttgcccaccgacgccacaccacgtttaattgtcgcacccgcttcatcggtgatcacaatacctgcaccatcagccaaaccaatcagtttcaacatctcagcatccacaccatcgggtgtaccatcaaaggtgacagacacattcttcatcgtagccacatcacatttctccagaccaatgctgaaactacgtggttcagaagagcccatgttagccagtgatgcagtagaaatttggcccagttcaacaacctgatcagccgcttcggaagtaattgaacaaggtgcttcaatgatagaaccggtaaaagtcactttacctttaccttggtcagcagcattagcagcgaaggcagaaagagacaatacagcagcaactaatacacttttcttgaagttagacattatataaccttaatttaatttgaagttttttcattaatatagaaagaccttattatcgcaaaatattttatctgcggaagcgtctgactacttattataatgaaataaaaagatgcaattatcgttacagccattttaaccgataaaaaggacatccattccttatgggaaagtcaaatcgataaaacaggctgtcatattcagttaatgcgtcatgcgttaacacaactcattattaaaggagagatttcgggagactaatgactccctacttagcgacttattaattcagcccctctcgaccatgtgaagaagtatacgcgattctttccgctggtaaatagagaattggcgggcatttagcgcgtaaagagactttacatgtgcgcattaattccataaaaacatgaaaaaccagtttatatgaccatcaagaattatcttggcaacagaaacacccagaatattaaccataagtaccacactgcggttacaaatataatgatggtgaagtcataatatcagaaataacatttactctctctgatttgacctacacatcaaatatgaatagggcgagttatttgtgggaattttcttaattttccacgatgacatctcataataccgtttatacccaagtgacttcgagttgccgaaaggcagtaagcgaaagacaaatcggtgtacgatggctttcacttataacgtgggggcgctgtcgcccttcaagatgcagggagttagctgcccttgctcaccccagtcactgagtgatggaataataatgatgaaaattttaggtcttattggtggcatgagttgggaatcaaccattccctattacagaatgattaaccagcacgttaaagcacaattaggcgacttacacagcgctaaaattattctctacagtgtggactttcatgagattgaacagcttcaggcaaaaggtgactggcaaacagccgctcaattactctctaatgccgctatctcattaaaacatgctggcgcggaggttatcgtggtgtgcaccaataccatgcacaaagtggccgatgatattgaagcagcctgcgggttgcccttactgcacattgctgatgccactgccgtccaaattaaacaacaaggaatagataagatcggtctattagggacccgctataccatggagcaaggcttttaccgtggccgtttaacagaaaaacacggcattgaggttatcactccagacgatacagaccgagaggcagttaaccgcattatttatgaagagctctgcttggggatcatcagtgaaacctcccgggatgcctatcgccgggtgataaagaaactcgaagcacagggtgtgcaagggattatttttgggtgtaccgaaatcacgctactggttaacgcgcaagatgcctcagtaccggtgtttgataccacagcgatacatgccagcgccgcggctgattacgcactgcaataattaagcatgtcactcacaataaaagaagaggcccgcaaccctgtaactcaccatagtgaaaaaacctatgttgtgaataaaacgtttggtcgaaaataaaaatcgaccgacagtaaaagttgctcgaatgtaagcattaataaaaagtaaaaagcctacgatctctcgtaggcttcagactgctgacaaaccccgatgacgcgatcttgaacggtgaggataggcagaggagtaaagcgtccgcgccaaggatggcgcggctcgagcctacatggatgtatttacggcgtctttacgatctgcctgttctctccgtcgcgggcactttgtcaataacctcaagcctacgatctctcgtaggctttggggagtaaatctgaatcagcaaaacagttttgcgtttaagcttacttctgatatttacgcatcactaatgttgcattagtgccaccgaaaccaaaactgttagacatcaccgtggtcagttcacgttgcgttgtctcagtgatgatattcatcccctgcgcttgttcatccagattatcaatgttaatgcttggtgcgataaagccatgttcaaccatcagcaagctgaagatagcctcatgtacacccgccgccccaagggaatggccagtcattgctttggttgaggaaatcgctggcgtgttattaccaaacacttcacgaattgcacctagctcttttacatcaccaaccggggtagaggtaccgtgtacgttcatgtagtcgattggcgtatcaacacctgccattgccatttgcatgcaacgaactgcgccttcgcctgacggtgcaaccatgtcagcaccatctgaagtggcaccatagcccacgatctcagcgtagatatgtgcgccacgggccagagcatgttccagctcttcaaccacgaccataccgccaccacctgcgatcacaaaaccatcacggtcttgatcgtaagtgcgggaagctttagccggggtatcattgtatttggtcgataatgcgcccatcgcgtcaaattcacaggccatttcccagcacagttcttcaccaccaccggcaaagacgacgtcctgtttgcccaattggatcagctccaaagcatggccaatacaatgagcggaagtcgcacaagcggaactgatagagtagttaacccctttgattttaaacggtgttgccagacacgcggagacaccggatgccatggctttagtcaccatataagggccaacacctttcaggccgcgtggagtgcgcatcgcatcagaaccagcaacctggttacgtggcgaacccccacctgaacccaccaccaatccgctgcggaaattagaaacctgagaatcagacaacccagagtcagcaatcgcttcttgcatcgcaagataagcataaatggaggcatcgctcataaaacgcagcactttgcggtcgatgagatctttaggctcagactggagttttacatcaccccatacatggctgcgcatacctgcgtctttaaattcttgagcgaaagtaatgccagagcggccttcctgcaaagatgccaaaacttcctgctggttattaccaatgctggaaacaatacccaagccagtaattactgcacgcttcattaaatacctcttccactaattttacattcgggattttgcaacgcactttagcgtacagttgtacgccgaacaagtccgatcagcgtaatatagccagaaagttttacaatttgcacgtggaacaccacctcgttagaatcgctctaccccttgagatacgagtcttctaacgtgaaccaacgcccaatccaaaccgcaacactcagctggaatgaacagggtacacctgtatctgaacagtttggtgacatctatttttccaatgaagatggtctggaagagactcaccacgtttttctcaaagggaatgggtttcctgcacgcttcgcttcccacccgcagcaaagctgtatttttgctgaaacgggttttggcactggtttaaacttcctgacattatggcgtgattttgccctatttaggcagcaatcgcccaatgctacgcttcggcggttgcactacattagttttgaaaaatatccacttcacgtcgccgatctagcctcagcccatgcccgttggccggagttagcctctttcgctgaacaactgcgagcgcagtggcccctaccgctggccggttgtcatcgtattttgctggctgacggcgctattacgttggatttatggtttggtgatgtcaataccctattacccacattggacgatagcctgaataatcaggtagatgcctggttccttgatggctttgctcccgccaagaatccagatatgtggaatgagcagttgttcaatgccatggcgcgaatgaccaggccgggaggcactttttcaacctttaccgccgccggatttgtgcgtcgtggtttgcagcaggcagggtttaacgtaactaaagtgaaaggtttcgggcaaaaacgggaaatgctgacgggcaccctgccacaacagattcatgcgcccacggccccttggtatcatcggcctgccgccacgcgctgtgatgatattgccattatcggtggcgggattgtcagcgccttgaccgcactggccttacaacgtcgcggggcggtggtcacgctctactgtgctgacgcacagccagcacagggggcatcaggcaaccgacaaggggcactctacccgttgctcaatggtaaaaatgatgcactggaaaccttttttaccagtgcctttacctttgcccgccgtcagtacgaccaactgcttgagcaagggatcgcctttgaccatcagtggtgcggtgtcagccaattagcgtttgatgataagagccgtggcaaaattgagaagatgctgcatacacagtggccagttgagtttgccgaagcgatgagccgtgagcaactcagtgagttggccgggctggattgcgcccatgatggcatacactatcctgctggcggttggctctgcccttctgacctcactcacgcactgatgatgctagcgcaacaacatggcatgacctgccactatcaacatgaactgcagcgattaaaacgcattgataaccagtggcaactgacctttggtcaatcacaagcggctaaacatcatgccaccgtcattttagcaactggccaccgcttacctgaatgggaacaaactcaccatctgcccttgtctgcggtacgtgggcaggtgtcacacatcccgaccaccccggtgctcagccaactgcaacaggtgttgtgctatgacggttacctgacgccagtcaacccagccaatcagcatcattgtattggtgccagttatcagcgcggcgacatcgcgactgattttcgcctaaccgagcagcaggagaaccgtgagcgtttgctacgctgtctgccacaagtcagttggccgcagcaggtagatgtcagcgataatcaggctcggtgtggcgttcgctgcgctatccgcgaccatttaccgatggtcggtgccgtgccggattatgctgcaacactggctcaatatcaggatctgtctcgtcgtattcagcatgggggtgagagcgaggtaaatgatatcgctgtcgcgccagtctggcctgagttatttatggtcggggggttaggctcgcgtggcttatgcagtgcaccattggtggccgagattctggccgcgcagatgttcggtgaaccattgccgttagatgccaaaacgctggcagcattgaatcctaaccgtttttggatcaaaaaattattgaaaggcaggccggtacaaactcgctccccggccacccaagagtcatcaagatgagtgacaagtgccgctaactatcacgcccccacggcttcaagaacgaaggggaacgcccaaagttattggcgtcgcaggtaggcagcaagtaaatgaatcccgatgagtctatctattttaaggtcaacaaccagtcagtgattcgggtgaatgcacgtagctaacacccctgcggcttcaagaacgaaggggaacgcccaaagttattggagtcgcaggtaggcagcaagtaaatgaatcccgatgagctgacatcagtcagtgattcgggtgaatgcgcgtagctaacacccctgcggcttcaagaacgaagggcgtgtgctaataaacgatcccaaagacctaacaccaaaacctgatctggaggggaaagctcaccggccttgatggccttctccagactggtttgtactcgcgcatgtaactgttcagcggagtgctcaccgtgctcttccgcttcagccacggccagtgtcagatggcctcgcaggtaccctccggcaaataaatcatcatcactggcgtgctctaccatgtcatcgatttgcgccaagatacgtgtttcaaattctgcgatcatcactcttcctcattatatttattttgtgcccaacgtcattggcattgcaggtaggcgctaaatcaaatctcccgggtaaggaaagagttcaggagccaacggcggcgtattgtaaaacgattggagtgcctgaataaagccctgaggtcgtgtggatataccctgatccagcaaccacaacacctgttcacgaacttttcgctggaatatgatgcgatctggctcgcagtcaccctctaggttgtcgcaactgacattgaaagggaaaccggcggcaacacaaaacatccattccaacgcctgtggcttgatctctaccgcttcaaattggctctgggttaatgcatcgcgcccatccgggcaataccaatagccaaaatctacctgcttacgccgttcctcgccagcaatacaccaatgggagatttcatgcatcgcactggcataatagccatgagcaaaaatcacccgatggtgaggagattcttcatcggcgggtaaatagatcggctcatcgtcacctttcaccaagtgggtattatattcgccgctaaaacaggtgttgaagatatcgattaactgctgataatgatgattcatactctggtccgtaagagagggtaaacaccgctaaagtcaccgtatttagcggtggtgggtgcctaaattgatgcaaaagccaagctatataaaaccaggctatgcaaaaacatgctgtcccagccaagagccaatttcagcaccgtggttgtcatacagcagcttgcaactcatgacgaatgacaccacgacaatcattggccgaattaatttctgaccacgcgtcaataccatatgtgcgccaaggcgcgcccccaggacttgccccaccagcatcaccaagccgatactccacaccaccttcccgccgatgataaagaatattagcccgcctaaatttgacgtgaaattgagtactttggcatgggcggtggattttgccagattaaaaccgcacagggtaacaaaggccaatgcatagaacgaaccggcaccggggccaaagaagccatcgtaaaaaccgatcccaccaccagcaattaatgcgaaaggcaaagcagacaagcggcgctgttgatcaaccacgcccagtcttggggtgagtaaaaaatagacgccaataccgatcaccaacagcggtaaaatttgtcgcagaatgtcagcccgcatgtactgaactaaaatcgctccgagcatcgaccccaccagcgtcagagcaattgtcagtttttgctgctttaggttaaccgcaccacgacgaataaagtacaggctggcggagaacgaaccgccaacagattgcagcttattggtcgccaaggcctgcgctgggggtaatcccaccgctaacagtgcggggacggttaacaagccgcccccgccggcaatggaatcaatgaacccggctaataatgcaacggcaaagagtatccccaaaacggcaggaccaagggtaaaccaatccatgacttattccgtagcgaagtggttatccagtaaagcctgacaagaaggcggtaatggcggtggcaaggttttacctggtttagcacttggcggaggcggttggaaccagctttccagctcagcaccacagccatcgcccggcggtggagtgtcttgatccacacactctaggctattggccggacaacgtaagcgcacatgcatgtgtgcacgatgagcaaaccacggccggactttatgcagccattgacgatcggcacctgcatccagacaaagctgctttttaattgccggattgacgaagatacgcgtgacatcgttatctttggcggccaatttgatcaaactctcaatttgtggctgccaaagtgcggggatcacccgcttgccatcaaccgcgaccaagtctatcggctgcggtttcaataactgctgctggctccaacgctgctttggcagttgtagccaaatatccacatccaaaccagactggtggctggcatgcccactgctaaaacgcccgcctgcaggcatcgccatatcaccaatcaacaccgtgcccaattgttgttgatgagcttgtgcactgagacggtgaataaaattcagtaaatcagggtgaccaaaataacggcgctgatccgaacgcatcacttgatagtctgcagactcgagcggcaaaggctgcgcgccaatcacgcaaccattagcaaagccaccgattgactgtggagaacccgccaccgggtgcgtaatcttttgccatggcgtggccgccatgacagggaccatggtgaccaatgccaccatacccactatccaatttttcatgctatctaccagcgcggaacgtctgaagccacatcgccgcactgcgcgcgctggcgcagtaggtgatccataagtacgatagccatcatcgcttctgcaataggtaccgcccggatacccacacacgggtcatgacgccctcgggtcacaatttcaaccgcttctccttgccgattgatagtttgccctggaaccataatgctggaggtgggttttaatgcaatgtgagcaacaaccggctgcccgctgctaatcccccctaaaatgccgccagcatgattactttggaagccctgcggagtaatttcatcacggttttcactgccacgcttagtgacgacagcaaaaccatcgccaatttccaccccttttaccgcgttgatactcatcaatgcatgagcaagatccgcatccaaacgatcaaataccggctcacctaaacctacggggacattttcagcgacgacggtgattttggcaccaatggagtcaccggcttttttcagctcacgcattagggcatccagcggctccagtttgctggcatcggggcaaaagaatggattttgctcgaccaaatcccaatcgagcaaatcacagctaacatcccccatttgcgccagataaccacgcacctgtacaccaaatttttgtgctaaatactttttagcaatagcgcccgccgccacccgcatcgcggtttcgcgggctgaagagcggccaccaccacggtaatcccgtacaccgtatttttgctcataggtataatcagcatgaccggggcggaacacatctttaattgcgctgtaatcttgcgaacgctgatccgtattttcaatcattaacccgatactggtccccgtagtgacgccctcaaatacgccggataaaatgcgaacttgatccagctcacggcgctgagtggtataacgagaagtccccggacggcgacggtcaagatccaactgaatatcagcctcggtaatcggaatgcccggtggtacaccatcaataatgcatcctagggcgataccgtgagattcaccaaaagtggtgacgcggaaaaactgcccaatactgttcccagccatcacggctcctttgagtcataagcggtctgccagatagagattaaccgtactgacagacttgataagaagtgatcaattaatcacggtacatgctgaaatgtgcagcgcagtcaatcagttgctgtttagtcagcataaagaccccgtcgccacccttttcaaattccagccaagtgaatgggacatctggatactgatccatcaaatgcaccatgctgttgccaacttcacaaatcagcacgccgtcatcctgtaaaaagtcgggggcacaggccaaaatacgacgagccagtttcagaccatcgctacccgcagccaaacccagttcaggttcaaaacggaactcttgcggtaaatcggccatatcttcggcatcaacatagggcggattggtcacaatcaggtcatatttgattggcggtaaatcgcggaacagatcggaacgaatgggcgtgacctgatgctccatgccgtgttgctgaatattgtgttcagttaccgccagcacatcattggagatgtccactgcatcaacttctgcgtcagggaaagcataggcgcaagcaatggcaatacagccactgccggtacacatatccagaatatgatttggctgatgatgaattagcccatcaaagcgattttcgatcaactcaccaattggtgaacgtggcactaatacccgctcatccacataatattccatgccacagaaccacgctttattggttaggtaagcgaccgggatacgctcgttaacccggcgaataacccgctcaacgatgcgatggcgctcgctggacgttaggcgcgagctgcgtatatcctctggaatatcaaggggcagaaaaagactggggaaaaccagttgtaccgcttcgtcccacggattatccgtaccgtgaccatagaaaatattagctgcattaaaacggctcacggtccaacgcagcatatcctgaatggtgtgcagctcatttactgcttcatcgacgaaaatcttgtccaaggtattctccaactgcttatgtgtaaatttattatctctatgcctagtttgccatgaagctcgtgacaaatcagcagcaatacatcagttgaatgataaccgaataataaaaaaagcctgcccccctatttaacttatattctaaataattcgagttgtcggaaggcggtaactgggcgacaaatcagtcataacccaatttaaacttggcttgcagcggcctcgccgcgctgaggcccatgaatgggatgagtaacgaaggtcgccaaggcataaacaactaaaagtatgacgaatatcgacatttatttcgacagatggtttgcagcaggtaaactgggcgcaattgaattaggtatagaacagacgatgaaaaagaaatatcacctgacaccagatgagttacagctatttaaagaatcgatagcgggtgctaaaaaactcagacaagacacaatcgtccaccatacaccgccgaagttaggcaaaaaaattgcaccagaacgcttgctgcaagagcaggtggatgccagttattatttttctgatgaattccaaccgctgttagatactgatggaccgacacgctatgttcggcctggtgtcgataactttgaagttaagaaactgcgtcgtggtgattactcgccagaaatgtttttggatctacacggtttaacccagaagcaggctaaacaagaactgggggcgttaattgcggcttgcaagcgcgaacatgtgcattgcgcgtgtgttatgcatggtcacggcaaacatgttttgaagcaacagacgccgctctggatggcacaacaccctgatgttttggcattccatcaagcccctaaagagtggggtggaaccgcagcattgctgttattgattgaattagaagagtgacggtacttgattgaattagaagagtaacggtgctggcagttatgttgtcagccaatagcgctgcatcagtagtcaataagcgggtgttcttatgtcatccgccaacaaacttgtttcgccaaaaaattaagtccgtgctgtcaataagtcaataagtcaataagtcaataagtcaataagtcaataagtcaataagtcaataagtcaataagtcaataagtcaataataagtcaataagtcaataagtcaataagtcaataagtcaataagtcaataagtcaataagtcaataagtcaataagtcaataagtcaataagtcaataagtcaataagtcaataagccaataagcgaaagcgcggcaagaatgccgcgccagttagacgttgatggaggctatattttagtggctggtggcttggtcatgacagcccatggtgagccttatccatgacacgccttcgccaacaattgtgaagggctcacctgccaatcaagcgtacccttttcgctcttaccattgagatcaatacaggcgatggctgaagtagcaaacatcggagggcattgccctgggcaaagctcggcgaccaaatacccgaccagtggcaagtgcgaaatcactaacactgctgcgcaatcttctttcgccaacgcttgcagataagaacaaatgaaggcggcatccccaccgggggttaattcgggcatcacttcaggttctgccggtagcgccataacctcacgcaccacttccaatgtttgtctggcacgtaaataagggctaaccagaatctgatcgatatccactgactgctcacttagccagcttgctatctgacgtgattcatcctgaccacacagagttagaggcctttgcgcatcactagcggcatcaagtgccgcgtcaccgtgacgcataatgaaaacttgcatattgcaccgtttttgttaaccaaataacgctatacagaaacgctttgcgtgctgtaccgccgaaacccttgcccgcaagcaaagaaacttcataacgataacgcgccgtctctctatggcggccgggcattttgcctgaaactgaacctaaagaaaatggctgtttttttacctcgcgaagactaacagcctaccgtgaacggtcatataataaccgcatcaatagcttaatccaaacttgaacacctatgcaataagtggctattgattcattttcgcacaaatagtcacataacgtaattcaagctaaggtagcgcgagctgccccatatgtatagccacattcccccttagaattccaggtggtgatcatgctcacattcttaaatttgtgacctgaacccgctagttttatgacttgagcccgacaattgcgttacataaatcgccctaaatcgggcaaataatcatcaccgaataagccatcaccccgtaaaccatcacaaaacgggtcgtcacaaaacaggtcaacacaaaacaggtcaacacaaaacaggtcaacacaaaacaggtcatcaccaaaaagcggggggcgggttcagcttgccacgtccgtcacctcatctatattggcgtccacgggatagaattgttgttgttgttcagccattgttaccaaccgctggcaaggttcgaaacgctcaccgtattgctgtaccaataatctgagtgcttgtaccaccttatcggctcccaggctatccaaatagcggaacggaccaccgaggaaaggcggaaaaccgatcccaaacactgcaccaatatcaccatcgcgcgggttacgaatgatcgattcatccagacagcgtaccgcttcgttcaacatcagcatggtacaacgttgagtaatcacgcctgcaccaagatgggctttaggtgtcacccccaacaaggtatagatactggaatcgactggttttactttgttttttctccacttaaagctattacgcttcgccggagaattcccattttttgttggagatgaattttttgtggaatttgaatgcagtgtggggtttgaatataaataaaagccacggccatttttgcgccctttacgtccatccttcaaaataacgtcaaatgacgggggcgcagcaaaacgcggccctaattgctcgaccagaatcggcattattttggtcgcaacatcaatcccaacctcatcaagcagcatcatggggcctacggggaaaccaaaatcgaccaacgcgttatcaactgattcgataggctctccgtcgagcaggcaacgggcagcttcattaatataaggtgccaaaatgcggtttacatagaacccagcgcgatcagccaccacaatggctgttttaccctgtttccgggctaaagcaacggtggtagcgatggtctcttcactggttttttcatgggggatgacttcaaccagtggcattttatctactggactaaaatagtgcaggccaataacctgctctggccgttgtgccaaagcagcaatctggctgatggggagtgatgatgtattggaggcaaaaatagtatgggcggcaccaaatcgttcgatgtcagcaaccatttgctgcttcagtgataaatcctcaaataccgcttccaccacaatatcgacacgttcaaaaccacggtaatccgtactaccagagatcaacatcatctgccgctgctgttcagttgggcgcatccgcttactacgaacccgtttacccaatgcgtcccaggtatatttcagcgcctgattaattccttgcggattgatatctttgatacgcactggcaagcccgctcgggtagccgttacgttggcaatacctccgcccatcaagccaccgcccaatacgccgacccgatgaattgcacgcgctgtggctgcacttccggtctcttttttcagtgacgtcgtggcgaaaaataggctgcgtaatgcggctgactgaggcgacatcgccaactcgccaaatgctctggcttctgcctcataaccacttggcccgccctgatctaatcctttacgcaccacatcaataatacgttcagccgccgggtagtgcccccgcgttttagctaacgtttttttacggacaatacggaataataaagctttacccaacggcccactgagtaaacgctcctgccatggtaatgctcgtcgattaagccaccccgctttcgcgcgctgaatcgccacatccaataagatatcgcgtggcacaacatcatccaccagccccatttttagtgcctgacggggccgtatctgtttaccggtcaatatcatatccagtgctttactgacccccactaaacgcggcagacgttgcgtcccgccggagccaggcagtaaccccagttgcacctccggtagcccgagaacggttttatcatccagagaacatatgcggctatggcaagccagcgccagctctagccctccccccagacaagcgccatgaatcgcagccacaaccggcacagggaaagcggcaatttgcgccaaaattgattggcctttttgtgctaatacgcgggcgtcgtgagcggtacgacaagccgcgatcatcgtgatatccgcaccggcaatgaaggagtctggtttgccagaaacaatgacgagtccctgtaattttggtagagcgtgcgcttgttgcaatatagtggcaatttgatcagcaaattcagcctttagggtattcactttgtcaccaacaacatcaatggtgataatgccaatattgtccggccttacgttgagggtaaatgcgggatgggtaactgaattcgtggccgatgcgcccacatcattattcactgtaggttcactgactgcattttcactgacagctgtattttcacgggtaacgatattttccttgctcatcactccacctccagaatcatcgcagcacctaacccaccagcagcacaggcggtggttaagcccaatcccccgccacggcgacgcaactcattcagcgtttgagttatcatccgagcgccagtagcggcaaatgggtggccatatgcaatggaaccccccaatacgttgaatttactcatatccacctctccgatggcttggctacgccccagtttttcgcgagcaaaagtatcactggcaaacattttcaggttagccagtgtttgtgcggcgaaggcttcatgcatatcgataagtgtcaaatccgccagtgtaatacccgcccggtctaacgctaatggcgtggcataggatggccctaacagcatatcctgccaaacatcaatggcagagaaggcaaaactgcgcaggtagcccaaaggcggcaaccccagagctttggcttttgattcgctcatcatgagtactgccgccgccccgtccgtcaacggagtactgttcgccgccgtcacactaccgtgctgacgatcaaacgccggacgtaatttggcatattgcgccaatgtggaatctttgcggatattgttatcttcaataatggcctctcgataaggcggaatataagccgtcatcacctcatcgtgcagccacccctgttgccaggcttcagcggccaattggtgggatcgcagcgctaaagcatcctgatcctcacggctgatgccataggtttttgccatctgctcggcagtatcccccatgcgcaggccggttgaatactctgccaccgcaggtgcaactggcaacagatcacgtaatctaagtcggctaaacaatttcaacttctgggataaactgcgggccttgttggcgtcaaccagtgtgcgggccagggctttactgacgccgatgggcagcacggatgaagaatctgccccgccggctatcgcgatatcaacggagccagcaataatactttccgcgacattggccaccgcctgaaaactggtcgcacaggcgcgggaaacgctgtaagcatcggtatgaacgctcatgccagtacccaaaacgatttcgcgggcaatattaggtgcttcaggcatttgcactacttggccaaaaaccagttgatcaatcaactcagaagaaatgccacttctggccagcaattcactgaccactattttgcctaaatctacagcgggtacgccatggtaagcagttgcctgcttggcgaaaggggtccgcaggccgttaactattacaatgcgatcgccctgacgcgtcactaacggtaatggcttactcataagcgctcctgataataagtagagtggctgcgattaaaagataacaaataacaggtctgacctgatccgaacattgttaaccaaacgtttacatttggcaaacctatagaatagaaaaatgcgagcaggagcaactttcaagataaaaaatgtgggaggagagaagggacggccatttagccgttacgccagtttatagactaacgtggggcatcatctaaagtaataacgcgaagcaaaaggcttcgcgttggtcaggtatgtgtgatcctttcggaaacgtaaattaacgcagaccgagttggaaaatcattgtttctgcctggcaggcaaaggtgaaatcgatagtcaaacgaacaccgccctcgacatcttccagtttatgttcaatcaggcatgggtctgattcgactgcccgtgctttatcagtcaatgttttcaacatcgcttctgcttcatgacggctagcaaacacacagctgtaggatgctgtccgatccgtattgtccatcactgtacccacatctacgcaacagcaagccgcggtttcttccgcactacaacgattaattgcatctgacatcgtcaattctcctcaacgaacatttcaaaataggtgcaaattgcctgttagctagcgcaaataagacctggcacaaaaatatttttctctgttgtcattttactaccacagatcgttaggcactaggacttactgtttataggcttattaactggtggaaatcacagttaaattgtctatcaactcatcaaaagcacaacaattgatacgtgattgtgagttttttgttaagtgcgtctattttttgagatcaaaattgaacaaactccaaaacatgcttgcaacactcgcacaggtcggacctatacttcagtcactggtctgctttgtctgaccgataacagaccctacaatcccgcactttcttgttacggtatgtaacatagtttaaataaaacaatgaggttttggtcatgaaccagaaaaacctgtttacccgctcagctctggcagcagctatcgctcttatttcatcgaacgtttctgcagccggttttcagttgaatgaatattcagccgccgctctagggcgtgctttctctggtgaaggcgcagtggctgataatgcttccgttggtagccgcaatcctgcagcaatgactttattcgaccgcccttctttctccggtggtgtgatttatattgatccaagtgttgatatcacggggacgtcgccaagtggcaaaagtacggatgccagtaacattgcgccatcagcgtgggttccgaatctccactttattatgccattggatgaacagtgggcaatcggtgcttctgcgacctctaactacggtttagccactgaatttaatgatgattatgtggcaggcatgttaggcggccaaaccgatctgaaaacggctaacctcaacctaagtgccgcgtaccgcctgaatgataacttcagttttggcctggggtttgatgcagtctatgctgatgcgaaaattgtgcgccatctcggtgaagctggcgggggtctattgcctgctaacactgaagccgccaggttggaaggtaccaaatggggttacggctggaatgcgggtattttgtatgaaatcgataaagaaaaccgctacagcttcacttatcgttctgaagtcaatatcgattttgacggtgattacagtaaccaactacctgttattttcggtggtctgggtggaaaaacggtccctggttccctaactctgaacctgcccgccgtgtgggaagtctccggctacaataaagtcgcgccacaatgggccattcactacagcatggcttacaccacctggagcagtttcaaggagttaaaagcaaccgcgtctaatggcgatgtgctgtttgataaacatgaaggcttcagagatgcctaccgtattgcgttagggaccacctattactacgatgataactggacattccgcaccggtattgcctttgatgatagcccgatccccgcaggaaaccgttcaatttccatcccggaccaagatcgtttctggctcagtgcaggtaccacctacgccttcaacaaaaatgcctctgttgatgtcggtattgcttatatgaaaggccagaatgtcagtattaccgaaaagaccccggccccatctaacaccacatatgagttcaactcgaaaggttccgcgatgctatacggtgtgaacttcaactacacattctaatagccagtcattcatcaccttatccaatagaaaagcgcctgatggcgcttttctattttgaatacggcggtgagtactgcgctagaccagttaatatcaatgagtctcaatcggcggcatctatgctatccagatcgccctgaatcgcctgagcattcgagttaacttcaggtttcagttggccaccattcgctaggaaatcatgacgctggaaataagcctcgcgtatcatgagataaggatctgaagaattacgcactaaaccatcagagtccaatagctgtgcgcgggtttcaaccccttcaagcacccatttccctgcggccatccagaacgtcagataactcagtaccggatacaccgtatctgccaactggccgccatcttcgcggagggtaaaactgccataccctggtagcaccacatacgggccgtagcccacatcatagtggcctaatgtactaccaaaacgttgaggcacttgttttgccagtttcggattagccatcccggcgacatcgatcaaaccgcccatacccaaaacggtattcaggaagaagcggttaaaatgcttcatcgcattatatggatcaccgaccaggaagctgttcaccatactggcgggttcttcgaggttacccaaaaagttgctcataccgttacgtgctggttgcggcacataatcacgccagacgacggcgaccggacgcaccacataagggtcgaggacctcatagttaaaattgaacattgcccggttgaaaccttccagcggatcagagcggccctgctccatgtgatccggtgaactactggcgcacccaactaacagtacgcttgcgaaagccaacccagtaaggcggaagttcatatttttctccatgaaagtctgtctatccctttcacttaagggatttgtttatttatttgaacgcctattttttgctcactcgacggcccattgcctttgaaatcctgcaccgcgctctcaccgtaccagtcgccagactgcgcattcgcggccccatccaaagagaggcgtacacgtactttcacctgctgtaaagaagagagcaaacgttctggcatcattgcattgctgtcatccagcgtaaccgctagcgggaatctgctcaatggcagttgctttacagcaaccggtaccggatttatgccattggtcacagagataatcagtgccccttgttggggtaatgcttgcgccgcatcagaggatagcgaaacctcaattcccagtgtagctgtttcttgctctatctgtgatttggcttgctgaatactgcgttttaccacgtctacacgtgaatcgctagccggcaacaattttagcataacttcccacacggctatcgcttgtttgaaatcaccctgctcaaaagcattaaaagccaataaactcatcgcacgtaaattcgtatggtcttgccccaccattgcacgcaacatctgtgtcgccaattggttatcttctggatcattggatcgggtgagtacttcgacatacccgagtttaacctcattattatcgggcgcgagttgataagcgtgcgcaaaagcctgtgttgcggtggtggcattattgagcgccatccctactcggcccaacatcatccaatcattgacgttaccagcatcctgttgcagagaggtacgtaaaccgagccccaagcgggccacatcctccatacttaatggatcggcatgttcgttggcaacccgagcgcgtaattcaggcagttgcgcagcaacctgatgccatgccgcgacctgctctaaaccgccggtttttaggtacaacccgaccgctaccaccaccaataccacgactccgggcaataatacccagcgattgatcgggttttttacttctcccaactgctgcgggatatctgtcagcaagttttgttgcagctctttaaccagttcaggccgttctgcgatcacgccctgcgcttcatcttcggccaattcagataaccgatcacgataaatagccttattcagctcatccctggtggtaacccgcttattttcattttttcggatgaccggaatgaccaataaggcccctgcaaccgccaacgaaatgatgactatcagccaaaaagccattatggttttttcctgtcagattcttcttgtaacttattattttgtaatgcgttattttgtaatacgctattttcagccaataagctttgtaaccgttgctgttcttgttgtgaaagtggcggctctttctcgactcgccgccgggcgcgtaacaccactatcgccgccccaattaacacaaacagtagcggccctgcccatagaattatcgtcgcagccgttactggtggttcataggtcacaaagttaccgtagcgggccaccatataatcaacaatctgctgtttggaataaccttgttgcatcagttcatacactttagcgcgcatatcggccgcaatggtggcattcgagtcagcaatactgttgttctggcattttgggcaacgcagttgctcggtcagtgcacggtattgctgctcttgttctaccgaactgaagcgataagtatcgatggtcgccaatactccccagctcaatatcagacccagtagcagactgagtaacctcatgcgcccccctggtactttttatacagcggtaagatttcctgctgccagacccgatcattaagatcaccagcatggcggtaacggataaccccttgaccatcgataaggaacgtttctggtgcgccgtatacccccaaatccaggcccaacattccatcaccatcatacaaactgagaaaataagggttacccagcgaattcagccactgcacggctttgctacggtcatctttataattcaggcccaccacacggataccttgagccgccaatttattcaggtattcatgctcggcacggcaagttgggcaccatgttgcccaaacattcagcagtatcggtttaccatcacgtaataccgcctgatcaaaggttttacccggctgttcgagggattccagtttgaatgccggtacgggcttgccgatcagcgccgactccaacatcgttggatcttcgccgttggcattacgggtcagttgtatcaggaatgccacgaccagcagtaagaaaaggaccagcggaataaacatcagcttattgaatgaggattgaggtttcatgactctgcctccggtatcgcaccgcgttttagctttttactcatccgatagcgcggatcgagcatacagaagatgccgccgacggccataaagatcccgccaaaccatatccaacgcacaaaaggtttgtaatacaagcggaccgcccatgagccatcgcccagctcttcacccaaggcggcataaagatcgcgggtcagccccccatcaatggctgcttcagtcatcattgagcgggcgacactgtaatagcgtttttctgcatgtaatgtggcctccaatttaccattacgggtgacatcaataatgccaacgccgccggtatagttaggccctttgatatcgtggacatcgcgaaaagtgaagtgataatcatggatatcgatactatcaccggccttcatgcgcacatcgcgttcgacactgtaattctggctaaacgcaatcccaattaccgtaaccgccaccccgagatgccccaacaccatgccccagtggctacgggaaaggtgagtcaacccacgccagaagccataacgatgggtggcccgttcgtgcaattccattaatgtcaggatgatcacccaaatggccatcatcaacccgacgaccgtcataccggcaacactatcttgcagcagccacggtacggatatcgataacagcagagtgaccaccagagccacactcaaccgcttccacagtttgctcggttcatcacgacgccaacgcacgagcggccctatccccatgagcaatgccatcggagccattaaccaagtgaacatcgtattaaagaacggttcaccaatggagatactgcccaatcccaactgtttgtgaaccagtggcagtaatgttcccagcaacaccacgagcattgcggcaataagcaacacattgttgccgagcaggaaagtctcgcgggaaaagacttcatgctgagtccggctgcgcacctgcgcgccttttaccgcatacagcagcagggaaccgccaatcacaatcaccagataggccagaataaacatgccacgggccggatcagaggcaaaggagtgcaccgaaaccagcacgcctgagcggactaagaatgtccccatcaaacacaaggagaacgcggtgatcgccaacaataccgtccacgctttgaaagtaccgcgcttctccgtgacagccagtgagtgaatcagtgcggtacctgccagccacggcataaaggaggcattttcgaccgggtcccagaaccaccagccgccccaccccaattcataataagcccacgctgagccaagtacgatgccaagcgttaggaaaacccatgcggcctgagtccatggacgtgaccaacgcgcccaggcactgtcgagcctaccggccattaatgatgcaattgcaaaagcaaacgcgacggagaaaccgacataccccatgtagagcagcgggggatggaaaatcaacccaacatcttgtagtagcgggttcagatcgcggccatcaataggaaaatcaggtaatgtgcgagagaacgggttagacgtcagaataataaatagcagaaaaccgccggtaatcattcccagcacggataacacccgcgccaccgcatcctctggcatcgaacggctaaacagcgctaccgccaatgaccaacaactgagcagcaatacccataataataaggagccttcgtgcgctccccaactcgcggcaatacggtaataaatcggcaaatatgagttggaattcgccgcgacataggagacggtaaaatcatttaccacaaatgcatatatcagacagataaatgacaacgtgatcgcggcaaacatgccataagtcagtggcctgccaaccgccatcatacgggcatcctgacgcgcggctccccattgtggatacagactcagcagcagtgaaatcgccaacgccaaacataataaaaaactgccaatttcagggatcataaggcattacccgtcgtattagtgccacgataagcggccgccgggcgagagtggttctctttcattgcctcttcaacttcaggtggcgtgtatttttcatcatgctttgccagcacttctttggcatggacggtattaccttcagcaaataccccttgcgccacgaccccctgcccttccctaaacagatccggcagaataccggtgtatgtcacggtgacagcgccacgcgcatcataaacttgaaaactcatttccaaagtctttgcatcgcgttgcacggatcccggcatcaccatgccgccaatacgtaaacgttggcctattgctggtttctcatggcgttcgcctttgccctgtaaaatttcgccgggggtataaaatagatcgatatttgaacgcagcgcatacagcaccaacgtggtggtcaaagagatgccgatcagaaccaccatcgccagatagagccgactttttctacgtgggttcacggtcgcttctcctgtaaattggcgatgtgctggggtgctgcttgttgtaacggtgcttgttgtaatggtgcttgatgtaatggtgcttgatgtaatggtgattgttgcaacggtgattgatacaacggtacttgatgcatcgatgtctggttaagctgcgcctgacgaatacgttgttcccgagcctgacggcggtgaatatcggccagtagctgtttgtgctgccacagcgtgtgcattagcaagcccagcaatgataacaaggtggctgccacagcgagccagacataaaaggcatagttgcccatggcaaaaaattctgcccatgagtgaaaagcgggggtcatacgcgcggctccttgagtaataaggcagtaacccaaggacggtggcgctcttgctgcaaaatcaaattacgcaagcgcattaatgtcagtgtgataaagcataaaagaaaacccaaaatcgcccagcgcagaggtgagcgcatactcggatcaatactttgctgcatattggtcgagccttgatgcaaggtattccaccaaacaacggagaaatgaataatagggagattaaccacgccaaccaacaccagaataccggcagctcgcccagccaatttacgatcatcaaatgcgttatatagcgcgatcacgccgagatacaggaataacaggactaattccgatgtcagccgtgcatcccagatccaccaagtcccccacatcggtttaccccacgcagagccggtgaccaaagcaataaacgtcaatactgcgcccaccggagccatagccgcgaccaggttatcggccatttttatctgccagaccaatcccacaaacgcagcaatagccatcgacatatagatgcccatcgaccaaattgccgccggaacatgtaaatacatgatgcggaaactgtcaccttgctgataatccgatggtgcgaaacccaatccccatacccagcccacagccagacaaataatggccccgcctccgaaccacggaataaggcggccacacaacggatagagccgttcaggtttggcgaattgatgaaaccatttccacatttttcattgctcattgtaaaaaattggacattaggcagacttaacatcagcccattgggtgattactgtatgctcacccgtaacgctgctgccgtcgcaaaaggcgcaagtgtcacactccctgccaacatcgcacccaaaatagccagataaccgtcgattggcatcgccattgacgcggcatcaatggccgccgtcgcaaagattaaaaccgggatatacagcggcaaaaccaatagactcaacagcaccccgcctttacgtaaccccaccgtcaacgccacgccgatagcaccgataaaactcagtgttggtgtcccaagcaggagcgtcagccccatcgcgatagcagtattgacgtccagagaaagtaataaagcgaccaacggtgataacaccaataaaggcagcccagtgacgacccagtgagcacatactttgcctaagacggtgagggggagtggtgtaggcaataacagcaactgttcaagggagccatcgtaaaaatcatcacggaataagcgctccaacgagagtaacgaggccaacaaagccgctacccacacgatgcccggagcaatgcgagccagcaattgtggctctgggcctatccccaatgggaacagcgtaataacgatcaaaaagaaccacagcgggttaacgatttccgcaccttttctaaaggctatttttaattcacggcgcaacacgctgataaacatgacttctcctgcgtgttggctaaacaaattttacggacattatggctaaccgcgcccaaatcctgatgcgtggtcaacagcaccattccgcccttagccgcatgttgtacaaacagggccaacaacgtactgaccccttgcttatcgatagcggtcagcggctcatccaaaatccacaaaggtgccggacttaaccacaagcgagccaaggccactcgacgttgctgccccgccgataactgagataccggtaaatcttcataccctaccaacccaacctgagctaatgcctgccagatggcggcgctatcaaccttctgaaaaaccgattgatagaacagcagattttcaaacggtgtcagcacagatttaattcccggttgatggcctagaaacaataaatcctgatgatatttggcgcgatcccgacgaatattattatctcgccagttcacttgcccctcatcggcctcagcaagaccggctaaaatacgcagtaaactggtctttcctgccccatttggcccttcaatctgcacgatctcgcctggtgcgatacagaaactcaactgctgaaataaacagcgatcatcgcggatacaggtcagattttttgcttccagcataagggggtgtcttccgatcgtcggatggccagttcaggaaaaccgaatgataacataaggcttaacccttacgtagggaacgcctaagactatccctacccttatagaggtaatattcggtaccagatcaaatttttgtaggaaagtccatcgacgttaacatttcatgatgtttttatcgtgacaataccattgggaatagtatggacatagacagagcagaatcaggcaggcagaagccagcgtagaaagcctagtgtcgttgttgacttaaccatcaggggacctttgttaaaaatccaccgccgtatttccatcggggtgcatgaatgctattaagcggtaaggctaaatattggggggaattacactgcgacggcggttttcagttgctgaagattattgatgatataacctccccctaatcgctctcactaattatttttatttattacaatggccgacgagttctttataggcatcatcaatttttttctttgcagcttctactcgaccactaacaagataagtatctgttcttttagggaaatcagttaggaagtctatatagcttttataaaactccactaaacctgacgtttcgataaatgcgagcaaagaaattcctatgacactatcatcatccacgcccttaaattttgtatatttttctagtacagccatccactcatcatcatatgaacggtaataccattcattaaaagcttcgacattgacatttgtttttgtaacttctttaccatcgcctggtttcacgttcattttacctgaaaaataagcggcatcgtcaaagataccgtatgcttgcttacattcatcagacatagctaaagtaccaaacgaaaccaccaacaatacccacaaaattagggtggattttattaaactcatcatcattccttgtcttattttttgccaagaccccgtcatacttcaagttgcatgtacgttggctatgtaatctctccagtttttagttccaccgccaaggagcattgccgtaagaacctcgcgttatacaacatgctatacaagttttgcgtggctgttacgggtatttctgggatttctttggacgtggatttttataacgcatttgtttttaaaggttttttaggctttattgaacatcttgagaagtgctaatggtgtccccgactggaatcgaaccagtaactagcccttaggaggggcttgttatatccgtttaactacggggacccgatcatcggcgcgctggatgccgatggggggtgaccggtgcattatacgcattttgacccaaataataagcagttagcgatctgtttggtcattctgtcgccaaatggtagtgaataaccatgaaaaaccgcccaaacctgttcatttatggcttgccaccttcctgtaactggaattatttaggcgatatatcatcacgatttacccagtctgccagtgtagggtgttatccatataaatatcatgggataatactttctctgtcaaacatggattgaaaaaaatggaaatttatatcggtttagctgttgttgccttaatacttatttgggcggtcatgacctataaccgctttatctcccttcggcgtttcaaagatgaagcctggagcgatattgcggtacaactcaagcgccgacacgatctggttcccaacctgctaagtctggtcaaacgctatgcccagcacgaaaaagaacttctggaagagatcacccgccaacgtagcaaccttgttggtaatacccgccaaattgccgaaaatgagcgagaatattctggcattcttggccgcgtatttgcgttagcagaagcttatcccgatttaaaagccaatgagaatttcctgtctctgcagcaatccctcgctgaaatagaagaacaacttcagatggcacgtcgttattttaatggcacagtacgggacttcaatattctggtggagtctttcccaagcttactgttagcccatttatttaattttaaagcagatgtattttttgaacttgaaaatcctgatgaagccaaattaccacggatggaatagcagaatggcacgcttgtctggcaaggcattatacgttatctggatcttattgttacttgtgacgggaaccgttcaggctaccgccgatgagatttccgtgagtacaccggctgtcgaagcaccaaagggccacggccttatccgtgcttatgaacacattctatcgttcgatactcatgcgcgttttgacgccgatggcagtatggagatgcgtgagaatattaaggtgttgtccctcgggaaacaaataagccgtgggattttccgtacgctgccgttaacctggaaccgacaggatggcaaatttttcagcgtcgaatatcagattaaaaatgtattacgtgatggggtggccgaaccttttagtgtgacgaaagaaggcgaaacactgatggtccgtattggtcgcgctgaccatatattgaagcccggtatttataattatgtgatccaataccaagtcagcaatcatttcagccgattccccgattgggatgaactgtattggaatgtgacaggtaacggctgggaatatcctattagtaaagccagtttccatctggaattacccgcaagcgaagcgtttctaaatagcgaaggcaaagatacccggttgagcacgattgatgtttataccggcaggctcggcgaaaaagagcaaaatgccaaaattctggccgatggtagcgtacagacgtcgcaaccactcaaacaaggtgaaggtttgaccgtcgcctatacttggccgcgcactattcttgctaacgcacctgcaccggaaacctcctcactgttagtctatctgctgctgcctaccgtgcaaaccagcgtattatggataccgatactcctcctcattggctattacctgctttggtggcgtaaaaatgttaccgcgattgggctgaaaatgccgccgatagtgccgctctatgcgctccctgccacgctgtcaccgggctatctgcgttatgtcactcagcgtaaatacgatgcgattgccttcagtagcgatttgctgaatttagtcgctcaacgtagcgtagccattaaaacaaaaaagagtaaaaacaaaagcccatgggttttaaacagccgcgatgaacagtggctatcactccaatccgatggcaatcagctcgatatccatgataagcaattactgcatacgctgtttagtagcaaccgtaagaatatcaatctcagtaagccccatcagcggccaatgcagaaggcgctgaagtttttagagaaacgctgtgaggatcagcaagagaagttattcagtcaatggcttgggccaatatggcgtggaatatttatcatgctattggtgcccgttatctgcggcctgctattcaatacgggtatcgccttcattactattcccgttttattgttgctgctattgggcatcaacctcctttctttaccgctgaaatttttatttagccccaaacaagtattggatagccggggggttctctctgtatgcttcgcgctattatttggcttattggctctccttcccgttggtctttttatctttaacctcccccccttaacccagttaccggctggatacttaggcgctttattggttgctattttgctctgcgttacttttaccaggatggtaccccgttacacacaacgagggctaaatcatcttgctatcgctcgcggactaaaattatatcttggtaccgcagaaaggcatcgctatcaggccctttatccgccggacaaactggttgcccattttgaaagtatgttgcctgtggctttggctctcggcgtgggtaaaacgtgggcgaatagttttgcacaatatttggtcagcacaggcaccctgtcggtggtctttgccaatgccgactggagcagcgtgagtcacttcagccaatcctgtagctcatccgctacggcaacccctagccgcagttctgactccagttccagctccagttcgagtggttcaggctcctccggcgggggttcgtctggtggtggttctggcggtggtggtggtggtggctggtaacgttcgtcagtcagggaaaagatggcgaatgttctgaatgagaagaatactcattaattttgtctgttattgggtatcagttcgatgtgtccgtcactcggtattgggacatttttttattctatttttattatttatccatcataaacaatgggttatttatttttatcgtggttcgccaaaaaatgaaaatccaggccggatggtataacagcgactctactgcagagacccgcaattatcccattacggccgttattcatcacttagctattctttaattaaataaaaagtgtaaaatgtatacacatcaatacagtaacctgtaattaactacgttttaatatttatatcgttttattttaaggagttaccgtgcagacattaccaaactgtccaaaatgcagttctgaatttacatggcaggaaggggagcaactgaattgcccggagtgtggtcatgagtggtcagaaagcagccattcaaccgaggccgacgagggccttgtggtctatgacgccaatggtaatctgctggctgatggtgatgcagtgacggtggtgaaggatctgaaagtaaaaggcagctcttcaaccctgaaaatcggcaccaaagtaaaaggtatccgtttggttgaaggtgatcacaatatcgattgtaaaatcgatggatttggccaaatgaagctcaagtctgaatttgttaagaaaagctaatgcattaatgggttctttgccacccaagcagagagcccttctattatcttggaagatcttattatcctggaatatcagcgcgctccggacataacatcgataataacgattatagaaagtaggctaaagccaataaaaataagccaactgactgagtggaaaggatacgttctggtgaatctggcaatttccgtcccctctttggtggtgaattttttgctaacaacccggaaactaatgatgtatccaaggctatagagataccacccaggtagtgtccataccgccaactgacgcccgccaataagggccaaacacagcggaatagcaaaaaatagagcaacagcgatgttatccatacgcttgagttgttctcgtattttatggtcttgtgccttggcggcttttctgcttaatgacatgaataactctttactcaccgtggctcaacgggcgcgtagttctgcgttatccgtctcaacgtcataggcaccttcaatacaaagatcgatagggtgcgggttccatttgattaaccccctaatctcaaactgtataatgccattcctggcctggagttgctggctgacaacgagagattccgccattatccgtggttcaaaacggataatggcctctctgataattcgttcaatagtcgcccaattatgcggcacggcataaagcccgaccaggggtgaaataccatagtttaagaccgacgtcgctacccatttatgacgctgcggatccaaccggtcttcaatattggcattatttaatatctctgaaatattacgttgtaccaatttccgcatcgtccgtgagtcataaaagaatttatcgtgaggctcaatatgctttttaggctcatcatcgagtaaacgctctaacaacgccggtaaaaactgttttttcttttccattactcagcctgttggcgcaaatacattttttatctaatacatgtgttatcaaacacaatctatttcaaacacaatctatctcaaatacaatctcttcaatatcaaacagcgcatgctcaccttggtcggtgataaacattttccgccctgccccaatataaagtgagtcagtcggttgatgccattctgttttaagacccagtttagtttcattgtctgtttcaggtgtcagtggatagcgggcaggtatataaccgtaccaaactttatcctttactttaacctgtgccggcgcccatatcaggtctgtaatatttttaggtttggaaacagtgagtgattgtatctctgcaaacgggacccaacggtaaccgccggcgctaataaactcacaaacaggccccatacgcccatcactgtcagcaatccaagcgaagcagcctgtcgtagcgctctctccgatactttccggtgcctgttgcagagcctgttcacggagggcctcactttgctgatgatcgccatcatggtggagttgattagcttgttgcaacaaggctacccattcaggcaggtcgttacccaacgtaccagggctgcgtttgcctgccagcacttcatcacgcattttctcactcaatatcagatttttatagagttcagcctgtttggtgaactcaggtaaaagctgtgtcaatgtttcaagctgcaatagggctttttgccatgaaccatcaatacaatagagtttgaataacagttctcgcgtatcggtatccgttggcttagcttttatcgtagcaatgacatcggccagcatttcggttaaagacgcgctttttaataactcagttaaattcgtggtattcattatcttgttttatccgtatttatagatggctgtccagccctagcttgtagagctcctgaaacatgagcgaaggcacactgtttttttcttttgttataaagtgttctggggctaatgcttttaataaatcgattttttcatcataatccggcgtatcgaggtaattaatagcactcaactctttggtcactttgtcaattagcccaccggaatctaaaatacactcggtcagggttttgtctttgactcgttccctgatattgtccaaatattcatcacgggcagataattttgtcacctgctgtccatctttttctaaaaattctcggctttgttctccccacaagagaaagcgcttgtactccacttccaaccgtttgaggatatccggctcctgctgatcatatgactgcgtctcatctactgcatcgaaataagagatgtagtgaccgccatgagacaagatatcttcaatttccggtaggtcagttttacctggttcctcagagccagtcagcataaacaggttatcagcaaaattatcctctacctgctgtgctgtcgctctttccgccgtgatgctaacgtgcccgaactggatctctgtaccaaaagacaaagaatggtgttcacccacattcaattgcttgccattgacctggcaaataaaattgctgctgtgattaacaatcaatggttcatgaaaatgccagtaaaactgcacctcattatgtccattccccacaggatggggagaaaatacccctttctctaggttaaaacagacagcattggccgcagtaacggatttatcgagccgatactgttgcgtagtattgggtgaagttaataccagtagcattggcattagttacctataaatacattgggcgacccagtgacaataaccgagccacaccccgtcttatcactacaacgcgtcgcgggacaattattgataaataccgttccagagccagttaccagcgccgtcaggcctaccaacgtagacgttgcgcccgaacccagcttagaggccggaatattgttaatgaacacatcgcatgaaccggtacatatcgcaccaccatcgctggtcacatcgcccatttttgccgcactgaacatacgtcacctcaattaaattctaaccgttcgaaaaatcagagaccgcatgctctacgtgtgtttcccacgcagaacatgcttaccttttatctataaaatcaaggcggtggcgtctgcgtccctggcggtgttcgcgtcggttccggcggtgccgttgtctctggcggtgccgttgtctctggcggtgccgtggtttccggcggtgccgttgtttccggcggtgccgttgtttccggcggtgccgttgtctctggcggtgccgttgtctctggcggtgccgttgtttccggcggtgccgttgtctctggcggtgccgttgtttctggcggtgccgttgtttctggcggtgccgttgtttctggcggtgccgttgtttccggcgcggtgccgttgtctctggcggtgccgttgtctctggcggtgccgtggtttccggcggtgccgttgtttccggcggtgccgtggtttccggcggtgccgttgtttccggcggtgccgttgtttccggcggtgccgttgtttctggcggtgccgttgtttccggcggtgccgttgtctctggcggtgccgttgtctctggcggtgccgttgtttctggcggtgccgtggtttccggcggtgccgttgtctctggcggtgccgttgtctctggcggtgccgtggtttccggcggtgccgttgtctctggcggtgccgttgtttctggcggtgccgttgtttccggcggtgccgtggtttccggcggtgccgttgtttccggcggtaacgttggatctggtggcaacgttggatctggtggcaatgtcggatccggtggcactgttggatccggtggcgatgtcactggtggcaccactattggcaacaagggtaacggtagcggtaaggcaatagcacccgccagcggcaataaacctgccaggctcgcaaaggcaccgaatgccccgccgccattgcccgttttacgaccacaacaatcatcagagttaatgtgaacttcaccgccctgaataataaccttacttttaccaacaatttttacgatatccccactgaggataagctcaccacccgccccaatagcaatagggccgccggccgccagtgtcgcagcaccacctacagctgtctgatgggctccccccaccgcaaggccattaaatccccctacattggtcatgttagcgccacccacattggtggcattcgccaaaaccacattcagtgaatgtgctccgccaaccacaacgctacgcgccaatcccacctgtagcatagaggctgcaccgatggctaacattgatgtgccaagaacatcttggttataattggccccgacaacttcacttcggttggccccaacattcaggaccgaatcggcaccgataatttgcgtttcattatttttagtcaaacgcgacatatcgcgctcggcctgttcccagtactgctccagccccgatttatcttcaaaacgaacgccgttatagttggttaacccgccgccaacagtacgactgaccatgccactttgcgtcgcattggcaggcaggtcccaagggggacgcgtcacgttattataaaggctgcccatcaccattggccggtcaggatcgccgttaatacagtcaacaatgacttcctgaccaatgcgtggaatatagatcccaccaaagctgttacctgcccaagcctggctaacacgtagccagcaagagtctgactcgctgtttgtgccatagcgatcccaaacgaaacgcacttttacgcggccatattcatcggtccaaatctcttcacccggtggccccacaataatggcgttttgcggcccattggttttcggttttggtgtcacctgtgggtgacgatagattttggtcgtcggctgaaccgtgaaagaactctcgcaactaaacgcatcctcaccgccagacagttgatcaacttcagccaccgtcaaacggctggagataatcatgtattcccgattcgctttatcaacggggaaccctttcagctcgaagttagcaccacaaactatcccgcgcagttgaccagaaccgaccgcccgcgaacccagagcaccacgttcttcgatacgcacgcgtgaaaggtgctcaccaatatctggctgatcataatcccctggccagtgataaatctcgagatcgttaaagctggttttacgcggtttactgtccattgccagaatatcggcacgggatttcgtgaagtcataatcgttggtgacccaggtcccactcgtcaaggtttcctgagtctggaattgtgtgatgtactcttcgcccgctttaggctcatctgacaagtactcaatggcatggtaggcggtactgaacgagcgtttatgcgcaccgacatgatccacaagaattaatttttgtttatgatcctgatgctcaaagaaccagtaaataccccactcttccatcaaacgctgaaggaaattaaagtcggtttcaccgtactgaacctgaaaatctaatatcggataggttgtagccaaccgtttctcaaacggaaaattatagtctgagaacacttcctctataatatcaacgacatttttattttgataaattttaaagtcagaggttaaattagccaggtagaaccaaggcttaatagtgatctcaaatatggcctgattggcatctcgaccaatgtatctggctctctcaaccagccccgtaatttcacgcgtgcctttacctacacttctcacatcacccaggccgttgccgtccagttccatttcaatcgtcatctctttaccaattaaggatttgagatcgacatttgaagccgcttgccaaggaattaatggattagccggtgtctttgccgtaatagtataagaatataaagtcgaaaaagcttcctcgccttccaacttagacagtaccagcgcaggctcacccaatagataaggcatagccgggctgctcaaatttattgtccttgacatactaatacctaatgtctagttaatatcgaaaagtgtgcatgacacttttaattgtctgttcataattacaatctcgtgagatcccattatctttccatacctgcgttgcctccaaagccatctaaatatctttccctgaacaacgcagccaagtcagtccatggcatccattgcatcgttacaactggcactcactctattaccgcactcctgcgactcgaatatttagggtatataagtcgcgaagcgggcaaataccgactgagtgctacccacgttaaatctgcgtacacttaccaaataccattcatgtcattgacactggggcatttgaaatctctcagcagatcgctaatggtttcaccaccatgcgttaaacctgagacttcaagctcgacacgatctttccccatgagataagtcagcgtctgtttgccattcgcttcatcgcgaatttcatcggcctgatcagcccactgcaagagtgcccaaggtccgcgaaaaagaatatcgggcatcgcggatgccttctggcgttgggccgttaaactgacaatggtgccttgacgtaaacccggccatttaaagaaggcaggcgttacgggaccatgggaataacgcacagtattaccatcaaaattcataataagttgggtgatagtgggtgctaaataacgcactgatacggaaaaatctaatgccatttttttaccgtcattggtattaaatagcacgtttctgatcattgccgcctgttcaaagaacgccaaaccttcactacttacgctgcccttataacgccaaggtattgaggaggtgtcgactttactctccaagtttttcttgaaataactgtccaccgtaccgtcagtaccgaagaaacgctcaaaatcattcaaactaacaatttgctcactttcagcaaatggataacgcccttgcagcgtattccggcaaatttcccccacccccatatcaatcgctttggacgtgtgagtaatcactttattttcaaatttctgagatgagcccgttaataacggtgcaataatatttctaaacggatccggccacgtttgtgattccaccgcaatacgttccccatcctgggataacggagggatatcgccatattcaaaggcactgttataaacaacaaaacgcgtatattgatcgtttaatgtcccgattattcggctcatctgcgttccctgaagaacagaaagattattgccccccggggcatcagcactctgttccccattaacaaagactctcagggattcaaaacgattatcaacccactctttaatcagtttattttcacgaaacgcgatcgtttcttgtaattttttagcctggctgagtaattgcccttgcgttctgatgtttatctcatcagtaatggctttttctttttcggcgagtgtcgtttcttttaccgcctgcctggctaaattgagtagcggtgaattttctgaaactaacgtccttaacaaagcaatatccagagacagcccttgagcatactctgcactgtccgcatcgacagaaatcagacgaacactggagagaaagcgtttccaataagcggcatacccttgtaaatacatcaccagaacatcttgtcttaacgtcaatgggtcaagagaagatgacagcgattgcgccatcacccacctatcctcttcttgaagtaacatcagcaaaggtgtcagtttttttttaaccacctcatggtaacccgcgtaggtataaagccctgggatcccttcatgcagtagttcatcatctgacagggtgaatacctgtgtcgcgtgctcacccaccattttacgtaacgtcatattggcaggggcatcggccaataagcgggattgaatacgcccccaaagtctggcggtcactgttttttccgccaatattgcccgagcctgcttaatcagttcactgtctgccggttgcccgtactgccgccagtctttcagggtaaacagcgtgttcaaatgaccgacgaaaatactcttctcttcgtaaggctcaatttttccacttttctgccaatcttgggtcacgtgctcaatcatatattgacgatcaaatttaccttcacccgtcagcatcaaataaagcttcaacgcggcataaacctcttcgctctgacctgagtgcatcgtttttcttaatgcaacctcactctgatgctcaaccattgggaagagatatttttgcaagaaaaactgatagagcgtgttcgcaccttgtgagattgcgctaccggtatataagccataacgccagtcaagctcagggttagccacatccagcgtaccgtactcgggtaactgctgtgtcgcgttcaataacgcaggtaagatctgctcattggacgttttggcataactcatcaccgtgctttctaactgactcagcttggcaccggtcgcctgtaaatacccctcgttatgctggaagctgaccaagaaggcccaaaccagccaaactgccaacccaatacaagccgcgtgtcccaatagattctgaaaacggtatttggattgtactttcaggttatagctgactaagtcggcatctttggtaatcacatcgctaaacaactgcttgaggaaatattgtttcccgtaagccacatcgctgataaaccgatcttcattatcacttttttgtgataaatcggctggcgataacggttttttatgattaataacgttacgccacttttgaatcagcgtgttgttatttaacagttcaacatccgcaggctgacaactgctgacaaaatagatccctctcagggtcgtgtgaaattttgtttcgtcaaagcgtgaggcgaagaaaacattctgtaaaacttccgttaccctctgggagagcatcctgaaatcctgggggagtgcatacatgccttttctgtccgccacggcatactcttcctgctggcggacgtgcatattattgctgatacgatcctcaagcagtgccagctcatggctgatacgttgctgaagtggcatatctgattgctctttcgcctcgttataagggaaagtcaccccccaaatttgctcgcgatcttcagccgttaaattacggaaatattcatcaaaacccgataattgatccagttttgtaatcgtgacatacaccgggaaacggacgcccaagaccgcacgtacctcatccaaacgcgtgcgtagcgtcgccgacacattcagtaaatcagctttacttttacccaagatatcggatgccgaaatcgcgacaatgacaccattaattgccttaaccggacgatattttttgagtgcctttaatatcccgctccactcagtctgattatctttgctgtcatcaatgtatttccctgaagtgtctaaaaacagggcgtcattagagaacaaacattcacaatgttgagtgggtgggttttctttgccaatacgattcagctgctcaggtaaaggaaagtcctgtcctgaagagaggataagggcggttttccctgcacctttcataccgacaaccatgaaccaaggcagttctgtgcgccaacggctggagataaagaaacgtcgccaggccggaataccactgtgaatacggcgcacatagttcatgccattgcggatcatcgcattaacttcagaaagttcagcctccgcttcaggcttggccgctttcttgtgcttaatgaagttatccagtaacgctggatttttcgccaatgctttgactaagcaccaggtaccataaataagtgtaataaatgcaatgatggcgataatgatgccgcgacggatcccatcagtcagaggatgatcatcaccaactaatatgaatgggccaatcacccataccgcagcacaggcaacgacggcggcaatgacaaagcgcggtgcgccgtaccaaaaacctaagatcagcagcagtgccagcaggatgcaaataattctggcttcataactttcgagaggccgcgcctcaccaaagccgaggaaaggccccagaaaccatatcgccgcagccagcaatataaagcagccgaccagcaatatgcgtttcatggcccagccagaaaacaatcgattcaaataagacattcgttatctcaataattaacaaaaatttctacgcggcggttttgcgaacgtcctgtcgcatcgtcattgctgctaaccggttgcgtttcccccttgccctcaaaccgaattttgtcggttggaataccggcctgttccatatagcgtgcaacattggccgcgcgtttttcggaaagtacctggttattagggaagccgggtttattaatcggcatagagtctgtatgcccgacaatgaggattgcccctttaacgcgatgcacttcctgcgcgacgcgtttaatcacgtcaatcatttcaggtctgacgttatccgagccgaccataaacatggagtcgcctttaaagatgactttgctgttgttgctcgtttcatcaacactgactaactgcttcgctatctcatcttttaataaaatagacagtcgaagttttggtgcggcaacgggtggcgtcacaaccacacgttgcaatgctcccattctttttagcaagtcactttccggtaccgagagaaagtatttacatccaataaaggtcgcgacaatgaggaaaccacacaacagcatggatacgcgcaccggaacaaaaatgccccgccgtcttctgttttgatgtgcgatcaacccatgcggagaaagtgccggtgggatcgtgtctcgggtactttggagcagcgtcagcaacccttggcgtattttagttaattgccgatcaccatcttcgataatgctgtagcgcccctcaaaaccgagccctaaaatgcgcagcaaaacctctaaaccatccgcatattcatgcgggctcatagagagacggccgaccaataagaaaaacttattcccgccgtcattatcgccttcaaaatggttcaacaggttgctttgtgaccaacctgccatcattccccacgacatcgtgtgagcggcttcatccaacgcagtacacaggcaatagcggacgatagccatttttttccatgagatatccgcttcatcacacaccacactaaagagggtgatctcatttttaaggctttgttttaatatatgaacctgtgaaacatccccaatatgcgcgggcatctcgctcaaggcacgtaatagtggctgtgccgcttccaataatggcgttgaagatgcgagtactttagcgacacgctgttgcacactttcaccccgtaagagggtcgtgtcatattgctgtgccgcaccagaatgaggggcctctctagtgaaggccgcattatcctgagtgctatctgggtatgtcattggttcatcaagcaagaaccggcctaatgcctgcggactctcatccacatttctgctttgatcaaaaggaggcattgagcccccaaggttcaaatcactgctgtcactcatgaatctctaatcccccagagctccattttcaaggccgggaaatcacccgccacgtgcagggcaatggcaccagcattggaaaccttgtcccagaaggggccattttttatcaattcaaaataaacgtaccctgcgctatacggaatttgtctgggcggtaccggcaaacgctgtagttccaaccctggcaaatgcgatcgcaccagttcatgcaattgctgaggtgcgctgatttttgtttgtactgaaaattgatgctgtagcacatccatcggtaattgcgcatgaacggcaaggaccagatttgaaaacgagcgtaattcattaggcagtacggaggcagaccaaacgccattgcctttcgtctccagcggtatcatctgcccagcacgcaccaagatctggttcagtagttcatgaacttcgtcaaccaacggacgaatagacgcatagagcttcgcatgatcatagccaggtgccggacggggtcggcgggttttggtccggataaaggtagataattcccccgagaacttagccaactcctgataaagcgtaataggtggtaattcaggaatgtgccttaaatgatcgagaatcggctcatatttattaaaaatttgcagtagcaaataatcgacaatttctgcgctggcgctcgctttcccatcactgtttgacaagcgattggccaacatctctgcgcgcattttaaccaaaccattaagatgggttaaccattcagacagcaatgaacttgcggcataacccgtcaccggaggaatataatcttcggtgtgtagcaagacactaccatcaggctgaatcgctctgactttggttaatggcagcccaatccatgattctgtcatctcaccttctgagactaatctgaggcgtaatcttgacagttgtaccggcttcggcccttgccgaatggcattggtatcgttgagcgcagcttcataggcgtaaaaacgtgccaatgagctcatatcgtgctcatcaaaaatggtttcatcactgttatccaggcgcagtgggaccgccagatagatcaacttacccagatgttctggggtgatagtgagcggttcaggcaattcagcatggccgggaatatcaaatggtgtaccgtcgggtaacacgcccttcccagatcgcaatactaatttgccatacgagagcgcttctctatcaatttcatattgcgcaaatccccaaaagaatggggttatcgttgccgctcgcttatgggcgtaatattcaagatagcgctcttgctgttgaaaaagttgtgggcgaagaaaaagcccctcactccaaacgactttgttagttctcacggcttaatccatttctttaattgatattgacagacgctcaacgcgtaccttcatgatcggatcttgttggtcttgccctggccacatttttttataccaagggtccacgcgctttttgggcaacggataaataaccgctttccactccgcctgttcaatttcacgataagcagccacgatgccgatagcagtaacgccagcatcaagtgtcagctctatttttttggtctcgcttggcaacataatccggtcaaacacgttatccatttgttcttttagcgatggcgtattttcttcagtgatagtgaagaaatcactcgactgaaattcatcggtgctcttgagtgtataaagcgcaatccttagcgggttcgccacccctttatcattcggattaatatccgctgctgtcgcgatttcgacggtaagtttttcagccttttcaggttgcacttttgaactacaggctatcgtcaataacgttaccagtaccaaaaataagtactgtgtcgcccggtaaacccctcggatacttttattcatacttagcctaattaaaatcatacttagcctaattaaaaaaacgttaagccttatccacaataatattttcagctacagattaacggcatcatgacggggctcattgacatccctgcacgctggcgctgctgtatgtccttttacacgtattgtggataaagcctgtaacataagttaggacgatgtacctgtcgtatatgtcactcaaaccacttattaagaaaacctgccaccccaagggtggcaagtttgatagcgacatgaacaacttaattagctgtgcatgttagctttaacatcgtagttagcagaaataacgccagatttatggccttcagcattctgcataacatagtcctgagtcatcttagtgaatgagaaacgaatttcttcacgtggacgcgtttcatcttccaaagaacccgccatatcaacacgagtaatgatgacatcggtaaatttaattgtcagatattccagcggatcgccaccggctttacgcagtacgaactgaacatttttaatgtgcttacccagcaagcaatagctcaataagttcgggctagctttatcgatataatgtgcgaagcaaaaatctgaaacagaggctttacctgaaccgccacctgaaccgctgtgcatattcgagtgttgagcaacatcccagttccaagctaatacctggatttcgtttttgtgattggcatccaaagactcaccttcaataccatcaattttgataaacatatcttgcgccataatatcctctctagcacttttataaatgtcactcaatgccaaacatcgagtgtaggaagaccccatataaatacggaggcacatccctttcctttgatacaaataagtataaaaatagtttttagttgactattgaaatactttacgaacaaccattactacatcattcaatattgaatactgaatgaataaaggtcccatgcaagatacagcatgaaaacacatccttttactgctgtataacaagacgtgaaacagttaaatatcaatgcttacaacacgttggcagagagtattgtctcgtcatcaacgaactgttttaatctatttaattatgctacgtctttcagcgaaggcagtttagcaaccatacgcagggagactgtcaaaccttctaactggaaatgagggcgtaagaagaatttagcctgatagtaaccagggttaccttcaacttcttcaacaatcacttcagcagcggctaaaggacggcgcgctttagtttccagagaagagttagccgggtcaccatcaacatagttcatcacccagtcattcaaccaacgttgcatctcatcacgctctttgaaagagccgattttgtcacgcacgatgcacttcagataatgtgcaaaacgtgaacaagcaaacaggtatggcagacgagcggaaaggttggcgttcgccgttgcatccgaatcgtaatattctgcaggtttttgcagggactgcgcgccaatgaatgccgcgtaatcagtattctttctgtgaaccagtggaataaaaccattcttggccagttccgcttcacgacggtcagaaatagcgatttctgttgggcatttcatatcaataccgccgtcatccgtcgggaaggtatggcatggcaggccttcaacaacaccaccactttccaccccacgaatcagcgtacaccagccatactctttgaaagatcggttgatgttaacagccatcgcataagccgcatttgaccacacatatttgctgtgatccgcgccatccgtcgtctcttcaaaatggaaggcatctaccgggttggtattaatcccataaggcagacgcgacaagaaacgtggcatcgccaggccgatatagcgagagtcttcagactgacgcagtgagttccatgcggcatactcaagattctgagtgaagatcttcgtcaaatcacgtgggtttgacagttcttgccaagattccatttgcaacacagacggtgcagcacctgtaataaatggcacgtgggcagacgcggcaactttgccaattgaagccaacaagtcaacgtcaggtgcagtatggtcaaagtaatagtctgctaccaggcaaccgtatggttcgccacccagttggccatattcttcttcatagatttttttgaataatgggctttgatcccaagcaacacctttataacgcttcatgttacggcgtaattcatctttagagatgtcgaggaaacgtaatctcaacttctcatcagtctcggtgttattgactaaatagtgtagcccacgccatgcgctttccagagactggaattcttggtggtgcaaaattaaattaatctgatctgatagcttgcgatcaatctctgcaataatggaagcaatgcttttataagcatcgtctgacaccgtgaccgaattagccagcgcttgctcagccaacgttttaacggcaccttctactgctgctatcgtctgctcagacttcgctttaaattctttagtcagtaatgtattaaaatcgctatattccgtcgcactggcgactgtagcttgtttagtttttgcgtcttgagtggacatagtttttctcttcttaatcaatcttactgtggagtatcaacagcggattgttttgctttcggtgcggatgcaagcgttgtcagtaatgatttgtctttcagcaatttcatgactaattcctcagcacccgccttaccatccatataagtctgcaagttggcaagttgagttcgggcatctaataattgagacaatgaatcaacttttttcgcgatagcgtcaggagagaaatcatccatactctcaaacgtaatatcgaccattaactggccttccccagtcaatgtattcagcacggcgaatgcaacacgtggtttcattgctttcatacgctcatcgaaattatcaatatcgatatctaacagttttctgtcagcgactgaaggtaaaggctcaagaggtttaccggataaatctgctaatacccccataacgaaaggtaattcaaccttcttttcactaccgtatatttccacatcgtattcaatctgcacgcgtggcgctcggtttcgagcaataaacttttgagaattacttttgctaaccatatatgccttaatttcaaacaaattgtaaaatcatcaggaaataagctccctgaaccgccacggagagatcatatgaaaatacagaactaaacgttctccccccccttatttgtaaaccaattcaataccagcagtcgctttgacctgcccaggggttaccgcattagttccttttgcataataacccgctagaaaataatgggtgatgtcttcacctgtagcaggaatgatatattcctgaacactatcttctctaccaacgaacatttgttgccctgtagctttacttaatcttacttgtacacttaagctgtaatcatcacccaactcattttgtaaattgcctgtcaccacatctggatttctggacgagtccgccgcagtaaaccgtaaatcaacagacctattggctggacatagcttcaatgcaatttgaaacgcttggttacctgcttctgcaccatcaatatttaatttgcttgtcgacagcgtcggtaaagacactgactcggcagatgaagcgccattaatactgacttcacaggtatcctctacatactcaccgccaaatgaaacctgaatatgacaatccgccgttcccgcacacgaactggcggcctgtgcgggttgtgactgagcaataaaaaccgcagtcagtaaaagaagtaacgcgataggtttttgtgcaaccttattttttagcgacgaagacatatcacctccaactgtattatttgcactgtctttgtagcagtatcgattttcgcatcaggtttaatgacacatttatctatgccgccatttaaggttgctgtaattggttgcgatacaggatcccatccacgaataaatgccattccaccttgcccaacaatactttgactcaccccatccgcatccaataaatcagtgccgataggaagaaactctttattttcatccctgacaataagcatcatcggattacctgtcatagttttcatcttgactgggatcatcgcgcccattctgggtaccaccactttatggttctccagaatatcgactgtctcaggcaagtctttataatcaatcgcaatggtattttcccgatacggtgtcagtgatggcaccagcgcatatccattactatcaatctttgcaccgcggccattaaacactttagcccctccggcaccctgagcattgatgatggcaaaaggcgcatcgccaagtcgtgggcccgctatcacgccgccctgatgagccaccaggctgccgcttgccgaaacagaaagctgtcgcgatgcgttattattggctgacgctgtcatacccaattggccaaccgatgactgataacccatattccctatcactgattgctcagaagacgcgtcattacggttgccatatgacgtacctattccataggtcaactcgttctgatctccccggctaccactcgtagtcagctgtaactgtgtatcacctgcttcactgtggctaaccatggtcgagagcgaactaaacagcggtttattcttcccactcccgccaataggtatgctgaccgcgagcatataactattttcatattcccgatcattgtcgccattactgctattactgctattactggtgcgtatcgcactcaccgtataagagaaaaagcgcagtgaatgattaaaacccaccgaatattgttgtgatgcatcctgattgccccagtagctataaaggctgctgttcaggttaactgacatattatccgctacgcgttgggagacactgagtgacaaccgattacgggtacgaaagtcaatttcatcaatcccattactgttcccataacgatccagactggcttccctaaaactgtaatacccaccggaagagtatctataggcggccaatgtcaggttggtatcggtttctcctacgtatttggagtaatcaattttatagctattaccgctggagcgacgatcacccgctaattcacttttagcatgtgtgatatccatcgatacccctcccaacggggtattgaacgcgttacctatcgcaaccgaacgataattctcagcaacctgtgccccaccatagagggtatacgtatttcccaaaccataatggtatgccccttggacaatcgccggattatggtttatcgaactgtcattcagttgacctgccgaaaaatcgaaccgggacaccccttggtaaagcaacatcgggggagctgaaaacgggatcctttggatacgcgttcggccatcagactccgtgatcgtcatttgtaaatcaccgccgtacgacatcgtgccgatatcggtcagttcaaaggctcccggtgtgaccaccgtttcataaataatttgcccgcgctgcgtcaccgtcactctggcatttgtctcagctatccctctgacgataggagagtaattacgtattccctccggcaacatccgagtatctgatgccaatagcacaccacgtaatgcataactgtcgaataaactcccttgggtattggtatccccaatcgttaattgactttttaacgcggtaatatctgtcgcggcatacccatacagattctgagtgtgcataccactgctattcgaccaggtagtattaagacgcttcctgaaccgccactcaccaagattaataccggctgatagcccaatattactgttgtagctatttgagttatctgaacctacatcgctgctagagcggccattaaagatgctataaacattactgttgtaatccagaaaaccaactgtcccacccgcatcccacaaactggaatcaatatacccacgcggatgatgcaccaaattaaactgcggtacggtgagtgaaagttcaagatcaccggagttatagttaacatggctgtctttaatcaatgcccttaagttgtaacactgatctttgggtgctgcttttccgtttactaataaatctgtatcgcttgtttcaattttcaggccaatagaatcaagctgttccagggtaaaacaaggttctgcggtagattccccttcgcttaattcaaagcggatacggtgtttaccgcgatttttgccattaatgatgacggtgacatcgtatactcctggtgcaacagggttttcatgcataaatcgcatgacatcgaccccaccaccgtgaataaagtcggcgttaaactcaacgggtatcactgctgcgctctcatttgtatcctgagacattggtacggcagagatactcttagttacgagtaaaacagagcctataaaaataaccgcaacgctcaatgaagctttgtagggtaaataatttaatttgccgatattattttctatgtagcacgctatatctgtacggttcactagcaaagctcccttttttaatatcagacgacttatcacatcgcttacaaaagatgtttacgttttcctgtccgaaactaatgcgttgacgccatagagttattatattgttttcagcaagatataattattttttcttactcactaagacaccttgcccttgagagaaagataattcctcatcaatggctgcgccataatcatttagtattttataattcatctttgaaatacttgtcgaacccaataacttaagttttgggaaaaacattttttcagaaaacggagggaccatatccgttattatttcgacacttttagcgccaacagtaatgctcccgctgtcaaaggaaatataataaggtgtagggttcaccactttcacaccgcgccctttttgattatcgtcaaccaacgtccatttcaactgggcgctttgtgcggcactattactctctaatgaggtaggacgataaaaaactttaattcgggtacgaaaagccaattctagcttattttgggtattaccctctttctttactgccggaatttccagcatattaaaccagaacactgactctttattctgtggtaatgccatgccgttataaatcattcgcacggtctgccctttacctggctcgacgcgaaaaacagggggggtaaccataaaaggaagcttcatgctattgatgttagcattcgtttttccgtcatcgacccaaacttggactaaagccggctgtacgcctttattattggtgcgtatgctcacttctttttcggctgccggaaatatcacacgtgtgccactgatcgtcatagctgcaaacgcggggatgctgcttatcgtcagcgacaacactaaaataattatttttgaaaacatcacgctaccaaataacaatgctttaaatcagcagacttatctttataacagacttgctaccgcagcgttttatccgcctcggcagcaagctgttatgctttactgctgcggtgacccacataaagtggaccacacgcctatcaccctaatcggtgattagttataagctaaaacgtattcaactttagcattcacttcacctggggtagttgcatctgttgcataataaccaccagcataggtcagattagctgtacctggtgtagcacctacgtagacgatgttgaccatgttacccgttgaacctacacggatctggctgctgtcatcaacgttgtacaaacgcacttcaacattacccgcagcatcagttggtgctttgttcaccaagttaccggttgccggattaacaccagagctatcaatcgcattaaaatgggcaccgacttgagtcagtgttgccgggcaatccagaactttgatttcaaagtccttagaaccatcttgagcttcagctacagccaaagactggatagaaagagtaggcagtgttaccgtgatattctcgcttgcggtatcaacctgacaagtatcagcaatcaatttaccgttgaacgtaacagtaccgccagcagcagcataagaagttgcagagataacagacagagccactgcacatacagcaagatttaatttacgcattgcgttcatcctttaatttaaaaatccagatttattaaacatatagttaatattcgctcatgccaatattagctattttttattgcctttcttttttcaagaaacagcaaattccttttcatcctttagcatgtccatctgcaataagtattactgagataaaagtctataggatcgacacccgtttaaacgtgatatctttagtttccatcattgtaaagcgatcacgaatccattttcatttttatgaacgaaaataatttgctcaggcttcacatcactatcacctaaaatatatttacctatttttggcgtaatattttgttcaatgtaacggatcagcatacgtgcaccggtttctgaaaccgcacagcggctaacaacatcgtcaaccacttcatcactgtatttcagtgtcaattgatgctgcgagtataaacgagcgccaatccggtcaagatgtaaccgtacaatgtgctgcaatgcatcttgctgtaacggaagataaggaataaccgtgactcgccctaaaaatgctgctgggaaaactttcagcaattcaggttgcaacgcagttaatattccatcctgatccggtgcagtatctggatcagctaataagttactcagtaactcgctgcccacattactggttaacagcaaaatagtgtttttgaaatcgataaagcgcccttcaccatcttccatttggcctttatcaaacacttggaagaataattcatgtacatcagagtgcgctttttcgatttcatctaataacacaacactatatggcttacggcgcacggcttccgttaatacaccgccttcaccgtatccaacatatcccggtggagaaccttttaaagaggaaacggtatgcgattcctgatattcgctcatattgatagtgatcatattctgttcaccaccatacatgctctcggcaatcgctaaggccgtctctgttttacccacacctgaaggccccactaacataaagacccccaatggtttccttgggtctgacagaccggcgcgtgcggtcataatattctcacccagttgcatcaatgcatggggctgaccaataacacgtgcttcaaggcgctgtggcaactccattaccgcccgaatatcgtctttgagcatttgcccaaccgggatgccggtccaatctgcaacgatactggcgatcacttcagcgttgacttctgtctgcactaacggcagtgaagtgcgaacctgagaaagctgcgcttccaactggactaattgcgcttgataagcccgacgtttttcctcatcaggctctggctgagaaaccaagtcataaagtgcggttcttatggtcgtaatcgctgataccaactcgcgttctgcctgccaacgctgatcaagtttatctgcagcctcgccatgttcagcaatggatgttttcaactgctcagtacgcgcatcctgcgctttaccaaagtgccgcgctttctctaaggaaaccagctcagtttgcgcggtctcactctggaaggttaagtgctgcaactctattggttgtgaatgctgtgcaacagcgatccgggcacaagccgtatcaagcagacttatcgctttatccggcaactgacgcgcagggatataacgatgagacaaccgtactgccgcctgtaaggcttcgtccataatccacacgccatggtgcttttctagcgcaggtatcaggccccgtaacatggagatcgccgtgttctcatcgggctcatcaacttgaagtacttggaaacgacgggtgagtgccggatccttctcaatgtgacgcttgaactcgctccacgttgtcgcaccaatggtacgtaattggccacgcgccaatgcaggtttcaataagttcgccgcatcgccggtcccggcattgccacccgcgccaataagtgtgtgaacttcatcgataaacaaaataacgggcttttctgccgcgattgcttcatccaagacactcttcaggcgcgtttcaaattcacctttcatgctggcacccgctgagagcgccacaatatctaatgacaacaggcttacctggcttaatgctggcggcattgagcctgcagcaatggccaatgctagcccttcaacaatggcggttttacccacccctgcgtcaccggtcagtaatgggttgttctgccgacggcgcaagagaatatcaaccattgtgttgatttcgtgattacgtcccaataccggatctatcttgccttcacgtgctaatgccgtgaggtctgtggtgtattgagccagtgtgccaccactttttgccgcaccgatggcattactggcttcgccaggtaaagctccatcgtacaacgggctgccatcactggcggcttcattcgcttctggtgatgcctgcgtaatgaagttcaaatctttgcttaaatgctctaatggaattttttccatgcttggcgcaatcgcaaagaaagctctccgcagttccattgttgttaatagcgccagcagcaggtgtccactccggatacgggtatctaaacactccaggctggcatagatccaagcccgttccgtggccaactcaatatgatacgaaaaatctgaaatgctagttgccccgacaggtaacttcgcaagtgcctgagccagctcacgctcaaaggcatccacatccaccgcaaaataccgaataatctgcttaaggtcgttatcttcctgatgccaaagctgattcaaccagtgaactaactctacgtaaggattgccgcgtaatttacaaatcgttgttgcgctttcaatacctttgaaaagagtggcgtccagcttgccgaagagatatttccttgtaatagccacgttttttatcctggtctttttaacggcgttcatgtgtagtttaaattgttcatgaaataatgcttgatgcaccatgaactatttctgcggctaagactaatcgaaaaaataaaaatgaaaagaacattcactcaatttcaatcaatttaagaattttgctcgacttaatgtcatgttattaattaaccgttaggaattttcttcaaatcatcttctcgcattcctaaataataggtgtttttttgaattaatacccgtcattaattaaccattaggaattttcttcaaaaatttttcccctattcttaataataggaattttgcccgtatcaaagtcctaaagtcacaacaataacagaagataaccctttgattagagtagccaatatttgtattaaattgccgcatacataatggtaatttcaaattctattgagtctatgtctttagcatgccataatttacgccattgaataaagctttaaaaaagtattatttcaacatcttctccaacagcgttttgtccattgaatgaaaaatattttcagtgaccgacgcacatcagaagaatattaacgtttttatttttcatatttgcactaaaagtattttgttacgcaaaaatattaacctattaaatagttaacaaatacaagcgactgacaaattttcaactgcaaatagtgatcatccgggaaaccaacgcctattttcctgaagttgacatagaaacacattcgacagtagggcgaaagaaagctgacataataaccggggcagtaagtggatcacaaatttcttgactattacaataaagaactcacttttatgcgcgaaatggcgcaagagtttgctgaaaaacatcccaaaatagcaggccgcctgggcatgcatgggattgaagtcgccgatccttacgttgagcggctgatagaatccttctgttttttatctgccagaacgcagattaagttggatgctgagtttcctaaatttactcagcgtcttttggacatcgtctatcccaattacaattcgccaaccccctcaatgggcgtgatccaacttaagccaaatctgaaggaaggggatttgactcaagggtattgtgttcccaggggcagctcgttcttcacccatatcgcacctggcgaaacaacccgctgcgagttccgtagtggtcaggatgtggagttgtggccactggaaatagcagaagcgcgtctaagctctgttcccccggatatgcctaatctggaaaagcaccgtattgcctatcatcggcttaaaggtgccttacgcattaaattaaaattagtgggcgatctcactttctcacaattagaaggccttgatcggctgcctatttatattgatggtgatgaacggatcgtttcacatatcttcgagctgctccacgccagccatgttgctaccatcatacgggcaggccacggagaaacagcaaaagataccgtgatcagtgatcagccactgtcctttgaagggctaagccccgaccaaagcctactgccgctatcatggaatatctttcacggacataatctggtgcaggaatactttacctgccgccagcgtttctacttttttacgctgacacagctgtcgcaaagtttgcgcgataatcataccggtgaagcggaaatcatcatcctactggacagattaccgcaggatttggtgagccatgttgccccctctcgtttcctgttagcctgcacgccagtgattaatctctttcctaaacgcatggataagatcgaaattaaccgtgcattgaacgattttcacgtagtaccagaccgcagccgcccactggattatgaagttttcgccattaataaagtatttggtcaacaggcggaaaccagcaacgaggtggtatttaacccactttatcaaacccgtcactgtgataatggcaactttgggcgttatttctccatcacccgcaaggccagaacgggcgatagcaacaaaagaaaatatgacacccgcacgccttacgccagtaccgaggtctttgtctcgttggtcgatcaacaagaggcgccttatggcgatagcctgcgctacctctctattgaagctcaggtgactaatcgggatcttccgcgcctgatttccgccagtggtaattttgaattgaccatgtcggattcagcgcccgttcacggtgcccggtttgtgttccaacccagcgccccacgcgccccctttgccatggatgaatccgcctggcgtttgattcgccaattgagcttcaactatctgccactgtcagatatgtcccactcgaatgggggggagtcactgcgcaatatgctacgtctgtttgttaacgcttcagaccatgaatcgaatacacaaattgacgcgctggtgggctgtaaaagcgagccggtgatccgccggttacccggcaatggcctactggtttatggccggggcatctgctgcaccttgaccgtggatgaagaaggattctccggtatcagcccttatctatttggcatgatcatggaaaattatgtggcccgccatgccgcaataaatgtgtttaccgagaccgagctaaactccatgcaaagaggacgtgtcggtcactggaaagcccgccctggcagacgaggagtcctgtaatgttgcccgatgaatccgttcaccaggaaaaacatgccaatctggacgcctggtatcaggagtctcagccatggaacgccggttttatcagcatgatgcgggcgaatgccgcccgcaaccctaccctgccagcgccaggaaaagcgcccttgcctgaacaggaagccttccgcatcgggcaaagtgcgcacatgacgttctctccgcgtgagatatctcatgcggttatgaaagacgggaaaatggatctgcaactttttggcttagggatttgggggccaaatggtgcgatgccgcttcagatgaccgaactggcctatacccgtgccgagttgcatgatcatacgatgacggacttcgtcgacctttttcatcaccgcgcattatcacagctttatcgggcgtggtttgtctctcaggataccgcctcgctagaccggcagagtgatgaaaaattctccttctatgtcggtagtctggccgggctggatcctcaagaacttaatgacaccgaactcccggttcatgcccggttagcctcctctgcccatttgattcgtgaagcgcgcaaccccgaagggctcgtgggcgcattgcagtattactttgacgtccccgtgcggatggtggagtacgccgaacagtggatctttctggaagaaagcgaccagacacaattgggtgatggtgccggcgcgatgctcttgggcgacggtgctattttgggcaataccgttttggatcggcagcataaatttcaactgatcctcggccccctcagcctgcaacagtacctgcgctttagcctctggggacaagacttaccagtattgcgagagtgggtacgtaactttgttgggttcgaatacgcctgggaagtccagttgttgttaagcgccgatgaggttcccatggcaacactcgatggcggacatcaattgggatacacctcttggttagcccgcagtgataccacccttgatgtcggtgggatgagttttgagcctgaaatgcatcacgattaattaatgcatcgctcttaatcaataatcttcatggccaatgtgctggcagcagaaaaaatagacaacgacgtccacccatggcgttaaaaggaacaaacatgagtgaacagagtatcgctgaacgtgccggttattatcaaagcatgatgcagcccattccaggtgactttccttgtggcaaaaatctggaatatgacccggcatttattatgctacagacaaaattgcagcctaagcaggccgctgaatacggcaattttgttgaggtcgctgaacctaataactggacagatatcgagcgtaaatgccttgaactcctgaataattctcgggatattcggctgtttattattctgatgcgctgccggatgcgtcaggtcggtgtgggcgcgttgcaagaagggctggaagccatactttggtgcctcgacacttggcctgatcagctacatcctcagctgtttgatgaaggggaatttgaacctttaatgcgcggtaatgcttttgctgaactggaagacattgatggttttatcgccgacttccgtaatcagcagttacccaaagccgctggcgtgcaactttccatcaaagagtttgaaaaggcacactccgttcctcgagaagaaggggcattggacgaagggactctggaagccgtcaagcaagagtggcagaaccgatcagatcacaccattctttcactccagcacgcttatgccttgttgcaaggattagccacgcgcctcaacaactccctcggtgaagacacacctgattttgtcagaatgacctcggtgttacgccactttgatgccgcgataaccccgatagcgcctatcgtggtgccagaacctattgagaccccagacgttgtcgagctctatccggtcgccacagcgatgctagcaagcacagaaatgccagtgaccgccgaggtacagacggttgcagagacacaaatggccatacccattgaggctccccaacagcgtcaagcggtggtaaccccatccccgccgttgcagccgttacagttgcaatcggcacagttgcaacctgtaccgatacagtcgccgccggtgcctgtccaacagcaggggatccaaaacagggctgatgcgttagcccggcttatagaggtgcgagagtggtttaccgccatggaaccgagtagcccggtcattgccttactggctttttcagaaaaaactatcggcaaaagcttcggcgaattgctgcagttcattcctcaggaactgatttcgaaactcaatgaaggacaggagtaatttgccatgacaaggaagctttttatattggtattcggtgcggccataagtggacaagtaaacgctaattgtacactccacttggtgagcaattcagaaagcgtcgctggcgtgatgccactgacattcccgattagctcttttactttcactattgatgccgatgcaccgaatgactctacagtgcctatcctagaaaaagtggcacaaccacaaggcttggcagtgatttatcactgcacctcggtcgatcgctacggcaagaatgtggggccgatattaggccaggatttaggtaatgggctttttgcaacgaatatcgatggtattgccatcaaacctgcatggaataacggcgcagcctatggctatttcaactcatcgggcatcatgcctgcctttgagcgtgagggcgttccgaccgaagaaggcttttggacatatcctggaacttcacacttcagattcgaactctataaaattaaagatacgttgaatttaactgacaccaacggcgaacgtgttctgccgggtggcacaatagcctatacctgggcgacgaataatagtttggcaaactacgcacaaagactggaaatcggtgaaataaaagtcatcagcaccccgagttgtacctttgacggcccccagaaggttaactttggtcttgtcacgtcaagcaacttgaataatgggggtatcgagcgtgatctcgattttaatatcacctgtaaaacggattatggccactactcagcaaccgcggccatttccacgcaaacgccatctgacgataataattacatcaaggtaaaagacaaccaaaaccaagaagaccggttgcttatcaaaatcagcgataccaacggccaacagatgaaagtgaatggcagcacgacagaacaacaagtcaatattgccagcggtgtacctgcagggttcagatggaaagcaaaactggaagccgccccagcagcgaataaaccggctattggtgatttttccgcgatggcagaaattattctgcagataaaataacgccatt
